United States Patent 11,446,398 (REGULATED BIOCIRCUIT SYSTEMS) - sequence listing, part 51

SEQ ID NO: 143140 - DNA, 15428 bp, Homo sapiens
  Payload ID: 8283
  Gene Symbol: INTS6
  Gene Name: integrator complex subunit 6
  Uniprot ID: Q9UL03
  ENST ID: ENST00000442263
  CDS Start-End: 491-838
gagaaagtggtgacaccgccggggtgcggagggagtccctgaaacttctcccaacagccccagggccaatcttccctcagcccactcccctcttcgccagctcccaggtccccactcctgtaccgggggtggggtggggagccaggcccgtctcccgctgggacacacacaggggccgggagcggggacgggacccccgaggcgggggggacgaaccgacagacagacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcaggtaggttgaataataaggtggcaaaatagttgatttttcattttgtggaaaaacacagtccagtccaaaaactacataacatgaaatgcaagtataaaacattccaaattaaaatagaatatgcacattgttcaaaggcaaaactcttaccctactatatatattttacatccctcattttttccccctctaaaatgcattggtattcaggattagaatctgaaacttttgctataaagttgacatacattggttttaatcccttgaaagttcagtaaagacctaaaaggaaaagcatcctaccacaccacactcatgttgtatgtgcaactattatagtggcttagagacactagttcgtgttcttcgtttctatattagtaaagatgttagaggaaattaatctgtttgttgcatcagggtttaatgtgaccatgttgtataactattctgaaaggtaagaagtttttcactggagtacagtcactggctgagaacatttaagttttcttttgaagcatacacagttaacaactattgcaggaagaactctgaattaaatttcaggcccagagttttgatttaaactccaaacccttggaaaaaaagactgctggaaaatatgaaagaacccttcgtttcttaacccccacaagtccttttattgcacttactttcatgtatttgaggatgagaggagctttaaatcaacaataattcactaaggaataatgcaaggtggtctattgtaacattttatgatattattgccctggaaataaaagatactgaacaatgtataatgttacatgtaacaaaggaatattatttccaaggagctcagttcttatgttgtagtgaaaagcactattcctaattatatattgggtatatgttgtattttcccaagtcccacagtccctagttttgtgagtttcgtacatttcagggaaattctttctgtgactacaacttttatttgcttcctattgaaggaaattgacttgtttctgttttaggaaattttaagcttcttagggataacttcagtgcttaagtgtctttggaaataactgaatttagttctataacatttaaaatgtacactgaaattcagagtgagcttaccaaattgaacttccaacgtttagttaggtaaatatgtactttcttaccacattaatacttttatgtttttcccatctctgctgcttttattttgcaacttttaataatttaggtagatttgcaatgaactttttggtttgtttctgtaaaatagtagtggatttccttctcttttatattcctttgtgatatgtagtgcaacacagtcttactgcttaaggttttcatccttacctctttgagttcaaagagatatttaaaacttgccattatttggttacctttatttggttgtcatgttgttagtgtatggcagaactattagtttcctctttttctgcatcacatttcataagtggtcaaggcatttggacatattcacctcctattacctattaaaaatacttcttaaagattgcttccttcgaaaaactgcttgtcatggagaggctgaggacatttgtaatttaaacctgtattttccttttcccagttgatatctgcccccagagaacactttagttcttgtctataaggcttaccaaaagtttgcgggaaaggtggtcctgtgctgttaccactttgaccaagagaagaacctggagattgggatgtttttgcatgtcaggatttattaattcaataacagagagggatgatgcttctcacttattctgatgaatcagcaaagattgcaaagcataatattaatgcttatgtcttgaattggcacattaaaaatgacactagcattaaaataagccactgttttcaaatgaaaatgataatttgagtaaagagtattgaattggaagaaaacattcttccagaagatttttttcatcataaaactatctgatttaaacatttcatgttttctattcacaacaaggataaatgattaggaattttggatgtctcaaatatttaatactgaatattgttcatgtgttttcttctttgtaaaagtactttgtatctgcctgtttgctgtggaatacttttattttgtaacttcaatgtctttacataagtatttcccctttcctgctctatactaggatctgtggtgttcacagtactaaatacttgtatgtaacgttagtagttgaaggaaatgagaaaagattaggtggaagatagaacgtatatattttatagaacatctaaaaactttaatgttctgaattactttcttaaatgtctgggttaatatatatatttgtatatttatgtagatatccaccattctcccacatatatgcacatatatgatttttcataactaattacaagactattaaatctatattgcatttgttaacttagttaacatacctacagataaaacatctttgaattattagctaggatgctatcagaatttgcagggcattagtaaggttaagtaactgagaaaaaagaatggttcttagtgaatgttttcctcaagcactttgggtatcccactaaaaaattccatgcctacagacattgttataaatatttaattttgataatcagtaccatttactgatatttctacagtaatggagcaatgtatagcctttagtcaatcttttcctttatagcagtactttaagttgcatatcattgcagataaatttgatacataagtttttcacgtgtgttcaacagagtttcaaataatgctgatcctttgagacctgctgaaagtctgaagcagccttaatatctaaaattaggaaatgtataaaatgtgagaggtctgattaaagttttatatgtagatgagttaattttcttattgttacaggtcatcctgttttccatcaatatatatgtatattttttttgagacagagtttctctcttgttgccgaggctggagtgcagtggcgcgatctcggctcaccgcagcctcctcctcctgggttcaagccattctcatgcttcagcctcctgagcagctgggattacaggcttgagccaccatgcctggttaattttgtatttttagtagagactgggtttctctatgttggtcaggctggtctcgaactcctgaactcaggtgatctgcccaccttggcctcccaaagtgctaggattacaggcgtgagccacagcacccggcccgatattttcaacattgtcttttttttttttttttttttttttcagtaaattatgttagttaagattagccaatatatctttactctggcctgcaagtccgtttttgttactgacctgattccacacccctgctacctgaagtatgttagtactgattaaattgttccaggagttagaatggcacctttcctactatgtgcccttggtgaagacaatccttgacagatatcttaaaaggagataaaatatgtgcttaattttttgaggattttctatggtgaatgtttacctcattgaaaaatggtggctttcgtacaatatcaaatttaatgattctcagggaaaagaattttaaccaattttatttttgagcataaaggtctattttgtaaacttaggagataatacagttatagttctaatactacttttttttccctttacctaaatagtacccatttaataggtagtgtgaaatacaggcttctttttgaaggctggcaggtgaagtagtgagaactccatttccatttgggtgcttggtttctcttagattatcaacaaatgtatgaataagagtttgatatttattaagctatagacatcttttcaaatgaaagtaagttaattactatacctgaaatactgctgtgttgaatataaactggaaacacaatgatgaatagtattttgtaaattttttaattcctttaattaaaatttttttttaaattgtggtaagaaacacctaacaaaatttaccatcttaaccatctttaagtgtgcagttcagtagtgttaagtatattcatattgctgtgcaaccaatatccagaacttttttatcttgcaaaattgaaactctatatcaagtaactcccagtccctggaaacctctattctactttctgtttttatgaatttgtctactctggatatcacagttaagtgaaatcatacagtatttgcctttttagatgggctcatttcacttagcataatgttctcaacattcatttatattttagcatgtcaggattttttcatcctttttaaggctgaataatactctattgtatgtaccacattttgcttatccacatatccattgatagtcacttgggttgcttccacttcttggctgttgtgaataatgctgcaatgaacatggttgtgtaagtaactttttgagatcctgcttccagttcttttggatatataccctgaaatgaaatgacaggatcatattgtaattccattttaaattttttgaggaagtaccatactgtttttcatagcagttgtaccattttacgttcctaccaacagtgcacgagggttacactttctttatatcttcactaacacaattttctgttttactttgacattagccatcctattgggtgtgaggtcgtatctcattgtggtttttatttacattttcctaataattatttatgttaagcatcaacatacgcttgttggccatttgtacactgtctttcgagaaatgttcattcaagtcctttgcccgttttaaaattgttttttgttgttgagctttaggatttctttatattttctggatattaatcccttatcagataaatgatttgcaaatattttctcccattatgtagtttgcttttatactctgttgtttcttcagtgcacaaaatttttatttttgtatggtccagttacatatttttacttttattgcctgtgcctttggtgtcatccacaaaatcattgctaaatccaatgtcactgaagcttttctcctgtgttttaagagttttatagctttagatcttctgtttagatctttaatctattttgaattaatttttgtatatggtataaggtaagggtccaacttcattcttttgcatgtggatatccagtttttccaccaccatgttgaagagacttgccctttcccatttgaatggtctctgcaaatccctgaacttttgagcctcaataatttttgttggtggagagggcactctcctgtcaaacttgcttaaatgttttttccccatctttattgtgtaaaagaagagcagtggctagaaatgtgagaattggaatcccaatcttggcctcgccattgaattattatgtaacattgagcattcacattactattttgagcctctgctacttcttattccaagttggcaataatgaagccattgtacctttaatatagaattgttgagaggtttaaatgggatgatatatttaaaatgtaccttattaggatgtctcactagacaaaagcatccttttcctccaaaagattagtatgtttacctctagttttctatttttttcagctttaattttgaaattaaaattataaaaatcttcaaagctgattattacatgctttaaacatctattagtatcacgaagtatatgtttttctttgggctttgtattgtatcccagaaaagcaggtgtgaaagaaaattaatataacttggccaaagttgtctcagtggcatttaataagcataggatgatgtttttaaagaagtgttaaaacaatttaaataatttagcagataagtcagaaagtcattcttttgcaagaatacttatgtgaaaaaagcacatgccttaggattctttcaaatagggagctccccctagtgcgttttagatgagatttacacaagtttgatttgcagggaaccttttaggagcacatatgttgggtaaatcaagggatagtttaataagatttaactgagctcaaagtagtacaaaatggatatgatttatttcctatagagcattaatttaatggtggtataatttaaatgagaaggaatatccccaaacccagattttattttcttttaaaacatttgcaaaatatttcttcagaattttatactctaaaactgttttctaaaagaaaaaattctccagtcatgatctgaaaaaaaaaaaaaaaagaaaaatgaaaaacactatcctaaggatgttattgcattctttttttttttgggatagagtttcactcttgttgcccaggctggagtgcaatggcgtgatcttggctcactgcaacctctgcctcccgggttcaagccattctcctgcttcagcctcctgagtagctgggattacaggctcccgccaccaccctcggctaatttttgtatttttggtagagacggggtttcgccatgttggccaggctggtctgaaactcctgacctcaggtgatccgcccacctcggcctcccaaagtgctgggatttacaggcgtgagccaccgcccctggccattattgcattcttaattagaaattgttcaaaacaaatcttaaatacaaaagtcaaaaataggccgggtgccatggctcacacctgtaatcccaacactttgggaggctaaagcaggtggatcacttgaggtcaggagtttgagaccagcctagacaatgtggtgaaaccccatctctactaaaaaaaaaaaaaaaaaaaaaaaaaaaaaaaattagctggggggtggtggcatgtgcctgtagtcctagctactcaggactcctggagtcctggttggaggattgcttgaaccccggaggtggaggttgcagtgagctgagatggtgccactgcactccaacttgggcaataggctgtctcaaaaaaacaaaacaaaacaaaaacaaacaaaaaaccaaataatatattctactttaaagagcattttactttctttcgatataggagaatatcgataattatgtattatatacagctggaaattaaaagatcaggaacaaatctaatatttgacatcattggacttatttgtgtattttgaattaaggtcatttgtggtcaaaattagttaaaaggattgtttatttagtcatgttcatgtcatagatttctacaaagagattatatagtattttatagcttgaaatgtttctcaaatatataaaatgatttttggccataataaccttgactcagatttatactctacaattaaattagtcttggtggacttttcttgttttttggggctttttaattttaaaaatgtttagatacaaagtctctctgtgttacccaggctggtcttgaactcctgggctcaagcagtctttccaccacgccttcggagtagctgggactgcaggctcttgccattgtactcagcttaaaaaagtaatttccttatataaactttatttttgtttagtcttactattagtctataaaagtttaccatggttgccagactttaaacaaaatactaaatttttaaaaaattttgttttggtttgtattttctgatctctaacatttttattgagatgtaacttaaataaacaaatctgaagtgtgaagcttagtgaattttaaaatatacactcttaaaaaaattgaacatttgcatctactgacaagttttcattaaactttctgtgttttattattattttcatagggctttagaatggaagtgattttagaagtttactcaattttcctcattttgtaggtgaagaaaaggcatagaaaggttcagaggcttaatttcttcacatttatgaaatatttttaaaaattgtaattggtgatagaacagttatggagattttattaaggatttgtatattatttaataacattttatttaaatgtataagcagtggatctgagttgctttcttcagttttgtgtatagttctgtaatgcagtatgatttctttcagttcttgtttgaaagctaagcttttcattttgtctctgttacatttagtctttcttgtaacattctatctaaatactgtttgttacaaaattagctttagttggattccttcctccctttgtttggcagaaagtaaatgaatttagggcagcggtccccagcctctttggcaccaggctggttttgtggaagacagtttttccatggattggtagaggtggttgggatggtttcagatgaaacttttccacctcaggtcatcaggcgttagagtctcataggagcgcataacctagaccccttgcatgcacagttcacaacagggtttgtgctcctatgagaatctaatgctgctgctgatctaacaggaggcggagccccaacggtaatgctcacttgcccactgctcaccttctgctgtgccacccattcctgatggggtccaggggttggggaccccgatctaggggataaaccaggaaagacttcttagaggtagtagcatctgaagaataaaagtttactgagaacccagaacccttgcaggttagggggcaatgcagagtgaagatcatgatcaatggccagatgcgatggttcatgcctagtaatcccagcactttgggaggctgaggtgggtggatcacctgaggtcagatgttcgagaccagcctggccaacatggtgaaactaaaaatacaaaaattagctgggcatggtggcgggcgcctgtaatcccagctacaggcaccctcaggaagctgaggcaggaaaatcgcttgaacccaggaggcaaaggttgcagtgagctgagattgcgccattgcactccagcctgggcgacaagaacgaaacttcatctcaaaaaaaaaaaaaaatcatggtcaaaaacataggagaggctgtccctgtggctcacacctgtaatcccagcactttgggaggttgaagagggaggatcactagaggccaggagttcaagaccagcctggccaacctggtaaaactccatctctgccaaaaacacaaatattagccaggcatggtggtgcacgcctgcaatcccagctactcaggtggctgaggcaggagagtcacttgaacctaggaggtggaggttgctgtgagccaagattgtgcgactgcactccagcctgggtgacagagtgggaatctgtctcaaaaaaaaaaaaaaggctggaggtggggaggcctggggacgtatgggatagttgacaggattttatactgtaattactttaaggcctagattctaataacatacataagtatttaatggcactttttggttttgtgcttcatactttaagtttctgatgtgtagctagttaatatagagctattaaccttgttcattagtcaatttttccaatgtagtatgccaaccagtattagggttacatttataacttttttcctggagagttgatgagttaactaccatattttcatttaacttaaggtagttttgaaaatttctaagcattatatcttaagattcagaaaaataagaccagatccacttatgaatttccattccactcgtgacctgacaagtcgtataacctctcagcctcactttccccattagacaaatagaatgaaaagacctatcttgcagaactgtgataaagattaaggaatgtacaacataatttattattgtaacacaacctattaatcatttttatgtattttctcttatttgaattttaaaaattgaaattatggggtactagaggtttttttaatcttgcttttttcagaacaagcagcatggtggtatggaaagaactgctgtattagaactggctgtgcctggttctgtcactcactagcttatattgtattgaaaagtcccttaatctctctgagcatcaagtttctcatccatagaattgtgattataccaatgcttaaattttgtgaggattagaagtaatatttgttaatcatctagcaaaagtgcctgcctggcatatggtaggggctcatttatgatgatgatcatcatctccagtattacggtaaacacttaacaggataaaagctttttagtctgaaacctttgacaaaaacagaattaaggttgttccataacctatcatacagttatgtatcgcttaacaatggagataggttctgagaactgcaccattaggcagatctgttgtgggaacatcatagagtatacctacagaaacctagatgggatagatgactatacccctaggctatatggtatatgacccattgctcctaggctatacatctacctgtatagcatgtaactgtactgattgctctaggcagttttaacacttacaagcattcatgtgtctaaacagatataaacattgacaaatacagtagaaatatggtatgaaagataaaaaatggtatacctagatagggcacttaccatgaatgtagcttgaggactggcagttgctctgggtgggtgagtgagttcgtgatgagtgaagtgaaggcctgggacagtacactgctgtagactttataaactgtacacttaggctacactaaatttattaaaaaattttctccaataataaattaaccttagcttactgtaactttataaacttctaaagttttaaaactttttaactctttttagtaagatttaagatacaaacatagctgtataaaatatttatatccttattctgtaagcttttttctatttttaaaattgttatttttttaaaaactttttttttttttgagatggagtcttgctatgtcacccaggctggagtgcagtggctcgatctctgcttactgcaagctctgcctcctgggttcacgccattctcccgcctcagcctcctgagtatctgggactactgccaccacacctggctaattttggtggtttttttgtatttttagtagagacggggtttcaccgtcttagccatcatgctctcctgacctcctgatctcctgacctcatgatccgcccgcctcggcctcccaaagtgctgggattacagacgttagccactgcactggcctttgttaaaaactaagacttacactcatttttctaggcgcacacagggtcaggatcattaagatgtcaggaggtgataggaatttttcagctgtattataatcctacaggaccactgtcatgtatatggtggtctgtcattggccaaaacattatgtgatgtcttactgtacatccatcatgagaagccataagtagctatccagttttttctggctaaagtaattttcaaagcaagaaaggttttaaacttctttgagaaaatttagagtttatttctaggactttgtatattttagaattcacgttggtgatggttgggatgggggtttaggggaggtgctctcctccagaagaaaagtcaagtgtaaaatatataattccttttatttgtcgtgtagatttgtgtaggaaaagacataataggataggcctaggaagaatttttttatatgaagatttttttttgaagggcatatataattggaaattgattattggtatatggagagagagaattgtacatgaaaagtactataacttaaaaaaccttacagttaagaggattagttgtaaccaaaggacaaatttatgtcagtctagtgattagtcctatcaaaaattattctagctttcatataacctgttttttattgcctgttttatctgtgacatgttgacatcttccttctattagtttttgcccaaatgaggtgtgggactcctagtgaaggtccttggaaggattatattttctataaaactttattagggacatgataacagttctgaatatgtgagaaaaagtaattgtatactattaggtgatgcagtttgtagctaggaaatgacagagttgatgctggtgtgtcagagtaaaactttccctttgtcttaaagcgagtgaaccttgttaggtactaggaaacaacaacagtcttttggttattctggggtttcaacactggaaatatctaataacagaattattctgaaataattgaaaactattttaaataaggaattgaagataattgaatatgcagtgtgaaaggtcaggctgcaagtgacagtgggtgatgttgcaagacaatgacaaggtacagtgcttttggattatcaggaattagcaaaatgatgtcttggtgtcctctggtaatttctgagttgtgaactatcttgcttatttatatactttggcaggtaatgaaataatgaatgtaaaattttgaattttgtgtaatcacatttcttaaaccaataagttagaaaggaaaaccaagagattgcatccacaagatcaggcctaaataggtagtagaaagaatagaaggtctttattttaaattttatttttaattcagaatgggcagtgtctaatcacaaatgagattatagtgaatgtaaatcttaatgtaacaaaggattatcttgccatgttcttaaagtttccattttaatgagctttagtaacattctaaaacatgtagcaatctgtgcagtcatccgtatgtgacatctgcttcttcatgaagtgcatttctaaggtaaaactattggtttatttgtatgtatagttaggaaggcttataaaacttttttttttttaatgataggcacaagtattatgtagttagattttttttgtttctggaaaatgttatctactttgaaaattttaaatctataaacacttgggaaggtgtttagcacaagcatcaataaatgtttcaatcagaatctagcaagaaaggattcttagaaacttttactcctgtacatgtactgtgtaatggatttagagaaatttgtttcctcctaaaaaatcttagcaatgttgggttagtaccatttctttccttgaaaacaaaaaaatccacattttttacgaaccagggccccttaaaactaatctcacattatgtcttttttttaattattattgtttttgagacacagtcttgctctatcgcccaggctagagggcagtggcatgatcttggcttactgtaatctctgcctcccaggttcaaacaattcttgtgcctcagccttcccagtagctgggattacaggcaagtgccaccacacctgactaatttttgtatttttagtagagacagtgtttcaacatgttggccaggctggtctggaactcctgacctcaagtgatccttctgcctcagcctcccaaagtgttggattacaggtgtgagccatcacgcccggcctcacattatgccttacccaattattttcagattggccttcagccatagcatatgggaaacaatatactgttagagttttccaagtgcttttcatgaattttttttccctttttaaaatttaatgctttattgctaactttcctgatctgaaacatttattaggcagttcttcattttcagttgtagcctttaagatatttatatagaaggctgtcatagaatgccatcttcttttgtaggacagttgtgtgtgtgaattgattttttttttttgagaccatatttgtagtgtgatgtgtagaaggaagtaaccagaatggttttatctgcttctttgccctacattcaaggtctgcttgtgatagtatttaaaattgagttcagtgctgagttcaagatgggatttaaccagacttttacaaaggtagcatctgtagattttgtagcagtctactcaaggaggtgattaatcttgagagactagacagatttcttttaggtcaaattaaattttaccattattgctgtataactccattcacctatctttgaaaatatgtttacatcttggtttttatttatacgtttatttttaaaaaacatatttctaacatgttttttattacatgcttcactagaataaaattttcccaagttattattacccagtttatcctgaaatcttagcctcaggcagtcctcccacctcggtctcccaaagtgctaggattacaagtgtgagccaccgtgcctggccccagtccatctaatgtatgtattagattcttagaatattactatttattaagtaaagttatatttctgatagcttaattactccttatatgacagcataaacactatttgcctggcactactttttaggcattccccagaccagtttgttaatttcattcaaactttagattccagttcaagtataaaactcaaattctgccaaattattaatatttcagatatattgagtttatattatcgtcttttgtagttatacttagtcttatcaattattgaatttccctaatgttattattatttttttttacaaagtcaaactttagtgattctgcagttcttatggtgacttacgatttcttacattattactcttcagtctattattaaatcaaattccaggatggagttccttagtcgttacattaaaacagatatatggaactcccccctacttttgcttaagtcatagtattccatctgtttttaatgctgttgtatttttaacataaggaattacgtggttgaataaaggaattgtatcgg

SEQ ID NO: 143141 - DNA, 3767 bp, Homo sapiens
  Payload ID: 8283
  Gene Symbol: INTS6
  Gene Name: integrator complex subunit 6
  ENST ID: ENST00000469430
  CDS Start-End: 267-722
agacggctgggcgcccgccccagcgggcaggcaggcaggaggaggcggaggcgggggtacgacggggagcactgggtctggggagtttcctctcaactatcgggggagaaactccccgcagccggaggaaagacccagacagtgttttcctcccgggggccgtgctcccccgccccgcgtagcggcggtcgccgccaccggcgcctccacctctaccatctcctctttctccaccacctcgggccccggtgtccccggccagcactatgcccatcttactgttcctgatagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgaggtactggggacacacagatggaattaagcaaggctagaaaacgtattatctttgaagacagctaaaggagcagcccagtggttttcaagaagtgctaaagtgcactgactgtctcatgatgactggtgcctcagggagggtcatgattcctggatacaggatcgacctgatcctggatgtcacttcaagcagtcagatcgtggggaaaagccttgtctaatggctagccttcctcaaaagtctgatgctagtcatctcggaaggcctcagaaaaagccttaaagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctattttactcttgtgtggtttaggaaataatcaca

SEQ ID NO: 143142 - DNA, 597 bp, Homo sapiens
  Payload ID: 8283
  Gene Symbol: INTS6
  Gene Name: integrator complex subunit 6
  ENST ID: ENST00000483288
  CDS Start-End: 219-597
aatgtgtttgagaaaactgttttcctcggacatgcaggcgtggactccttacttcaggtaaggtgacagcagcttgacagagagtgccttccctcccacggcatttgggacgaggctgaaggaaagacacaggcggggttacgggaaacccattctctgcgccatctgggcaagctgaagtcagtttttccgctttctcacgagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggag

SEQ ID NO: 143143 - DNA, 483 bp, Homo sapiens
  Payload ID: 8283
  Gene Symbol: INTS6
  Gene Name: integrator complex subunit 6
  ENST ID: ENST00000483746
  CDS Start-End: 21-483
ggtctttgtgacagttaaatatggaggatgaggggaagatatcaagaataacggctaggtttttagaacagccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggag

SEQ ID NO: 143144 - DNA, 452 bp, Homo sapiens
  Payload ID: 8283
  Gene Symbol: INTS6
  Gene Name: integrator complex subunit 6
  ENST ID: ENST00000488009
  CDS Start-End: 184-452
ggcccggaagccagatgcggggctgccaggattggtcttgtcagattcgtcctaagagggccggtgggacagctgcaggttaacttcctaagtccggctcccatctgcttccactagtaccttcacatacccaaattttgggtattagattaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgaggtaagttgtgcttatattacatggattatgcaaatgcagttgaacaatcctttattttt

SEQ ID NO: 143145 - DNA, 496 bp, Homo sapiens
  Payload ID: 8283
  Gene Symbol: INTS6
  Gene Name: integrator complex subunit 6
  ENST ID: ENST00000491189
  CDS Start-End: 102-496
aagccagatgcggggctgccaggattggtcttgtcagattcgtcctaagagggccggtgggacagctgcaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcgg

SEQ ID NO: 143146 - DNA, 474 bp, Homo sapiens
  Payload ID: 8283
  Gene Symbol: INTS6
  Gene Name: integrator complex subunit 6
  ENST ID: ENST00000485178
  CDS Start-End: 85-474
tccggcgcccgcgaggccccgagtcctcctccggagggcggctgcgggcctgccctcttctcctaaccagacacgtctgcctctatgaaccagcgcagccatctgggcaccacctacctggacacggccaaaggcgcggtagagaccttcatgaagctccgtgcccgggaccctgccagcagaggagacaggtatatgctggtcactttcgaagagccgccctatgctatcaaggctggatggaaagaaaaccatgcaacgtttatgaatgaattgaaaaaccttcaggctgaaggacttacgactcttggccaatccctaaggacagcttttgatttattaaatttaaatagattagtaactggcatagacaactatgggcagggaagaaacccttttttcttggagccagcaataattatcacaattactgatgggagcaagttgactaccaccagtggagtccaggatgag

SEQ ID NO: 143147 - DNA, 3022 bp, Homo sapiens
  Payload ID: 8283
  Gene Symbol: INTS6
  Gene Name: integrator complex subunit 6
  ENST ID: ENST00000497989
  CDS Start-End: 369-2498
gttttgtttgttgtggttttgatgttttttttcctttcagctaaaggagcagcccagtggttttcaagaagtgctaaagtgcactgactgtctcatgatgactggtgcctcagggagggtcatgattcctggatacaggatcgacctgatcctggatgtcacttcaagcagtcagatcgtggggaaaagccttgtctaatggctagccttcctcaaaagtctgatgctagtcatctcggaaggcctcagaaaaagccttaaagcttcatttacctcttaattctcctttgcctggaagtgaattgaccaaggaaccttttcgttgggatcagagactctttgcattagtgttgcggttgcctggcaccatgtcagtagaatcagaacagttgacaggtgtgcctttagatgactctgcaatcacaccaatgtgtgaagtgacaggcggccgttcatattctgtgtgttctccaagaatgcttaatcagtgtctggagtccttggtgcagaaagtacaaagtggggtggtaataaactttgaaaaagcaggaccagatccttcccctgtagaagatgggcagccagatatatcaaggccttttggatctcagccttggcatagctgtcacaaactcatatatgtcagaccaaatcctaaaactggggttcctataggtcattggcctgttccagagtctttttggccagatcaaaattcgccaacactaccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtggccacttatttcactatcttcttcaaatacaaagtaaatacaagactgttgtgatcttgcattcattttctgacatgcattgttggctatttgaaatactaaaagcaaatctacagatcctttttccatcattttacagtgaccttttcttcattttggtttatttttgtaatgtgaaaagtatcactctaaaaaacatttttaatttaacaaactaaaaatattcctccaaatctcttgcttgtcattgactcttgcgtgtcaatttccctcaggttctattttcttaaaccaacctttaaaattgtcacctctgttaaggttgaactttgccaaaaaaaaaagaagttactttgtaatttttggggaaaaaagcacatacattaaaactaggtaatgttttgtatatacagttattttggatatattattgtaagttgtacaaatgtattttgaagaatatttaagaaaagcacttttgttattccatcaataaatgctctatttt

SEQ ID NO: 143148 - DNA, 2307 bp, Homo sapiens
  Payload ID: 8283
  Gene Symbol: INTS6
  Gene Name: integrator complex subunit 6
  ENST ID: ENST00000490542
  CDS Start-End: 576-2291
agaggaggtgggcctgacagcctggtgtgtttttggagtacagagtgggaaggggtatgagggaagaggtcttttagaggttgttacatgccaactcatttttctaaactttgtttgcaatatgcaagggagaaaataagtacttggcatggctgaagtatggagtctgtatggcgtggtggtgggaaggcagatagggaccagatcactgaagatctttatatgtgatattaagtgtctagaccctatttttaggtgattggctgttacttttaccgaacagttttagatagggaaattatatgatcctatttatatttcactgccatggattgatcagacagggactgattagaaactaaacaaagcaaaaagcatttgtactagtctaatctgagaaatgatgaaggcccaaattaaagtggtaagaaatagaagataacatttctagagagatgagagtttagtattgacagaaggcagcaactagtaatgactacctaccatgtttatgtgttctgccacctcgtacatctcatcctgtagtgaagttttcctgtacagactgtgaaccaatggttattgataaacttccttttgacaaatatgagttggaaccttcaccactgactcaatttatcctggaaaggaaatctcctcaaacatgttggcaggtgtacgtgagcaatagtgcaaaatacagtgaacttggtcatccttttggttacttgaaagccagtacagcactgaactgtgtcaacttatttgtgatgccttacaattatccagtccttcttcccctcttagatgacttgtttaaagtgcataaagcaaaaccaacattgaagtggagacagtcatttgaaagttatttgaagacaatgcctccctactatcttgggcccttgaagaaagctgttaggatgatgggagcacctaacctaatagcagacagtatggaatatggacttagttacagtgtcatttcatacctcaaaaaactgagtcaacaggccaaaatagaatctgatcgagtcattggatctgtaggcaaaaaagtagtacaggagactggaataaaagtccggagccgatcacatggtttatcaatggcatataggaaagattttcaacaactcctccagggaatttcagaggatgtccctcacagactgctagaccttaatatgaaggaatacactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctccagccagtttactggaacggccaaccaatcatatggaggctcttggtcatgaccatttaggaaccaatgacctcactgttggtggatttttagaaaatcatgaggagccaagagataaagaacaatgtgctgaagagaacataccagcatcttcactcaacaaaggaaagaaattgatgcattgcagaagccatgaagaggtcaatactgaactaaaagcacaaataatgaaagagatccgaaagccaggaagaaaatatgaaagaatcttcactttactgaagcatgtgcaaggcagtttacaaacaagactaatatttttacaaaatgtcattaaagaagcatcaaggtttaaaaaacgaatgctaatagaacaactggagaacttcttggatgaaattcatcgaagagccaatcagatcaaccatattaatagcaattaaaagaaaatagaatgtg

SEQ ID NO: 143149 - DNA, 3380 bp, Homo sapiens
  Payload ID: 8284
  Gene Symbol: INTS7
  Gene Name: integrator complex subunit 7
  Uniprot ID: Q9NVH2
  ENST ID: ENST00000366992
  CDS Start-End: 84-2912
aagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctg

SEQ ID NO: 143150 - DNA, 3422 bp, Homo sapiens
  Payload ID: 8284
  Gene Symbol: INTS7
  Gene Name: integrator complex subunit 7
  Uniprot ID: Q9NVH2
  ENST ID: ENST00000366993
  CDS Start-End: 100-2946
cggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggagcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataa

SEQ ID NO: 143151 - DNA, 4417 bp, Homo sapiens
  Payload ID: 8284
  Gene Symbol: INTS7
  Gene Name: integrator complex subunit 7
  Uniprot ID: Q9NVH2
  ENST ID: ENST00000366994
  CDS Start-End: 106-2994
agcgcgcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccccttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttg

SEQ ID NO: 143152 - DNA, 3136 bp, Homo sapiens
  Payload ID: 8284
  Gene Symbol: INTS7
  Gene Name: integrator complex subunit 7
  Uniprot ID: Q9NVH2
  ENST ID: ENST00000440600
  CDS Start-End: 103-2844
gcgcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttgggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatac

SEQ ID NO: 143153 - DNA, 560 bp, Homo sapiens
  Payload ID: 8284
  Gene Symbol: INTS7
  Gene Name: integrator complex subunit 7
  ENST ID: ENST00000612340
  CDS Start-End: 1-459
gcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttc

SEQ ID NO: 143154 - DNA, 4447 bp, Homo sapiens
  Payload ID: 8284
  Gene Symbol: INTS7
  Gene Name: integrator complex subunit 7
  ENST ID: ENST00000469606
  CDS Start-End: 100-363
cggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggcatgagatgcatgtctgtgaagtacctgaaacataaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccccttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttgtg

SEQ ID NO: 143155 - DNA, 795 bp, Homo sapiens
  Payload ID: 8284
  Gene Symbol: INTS7
  Gene Name: integrator complex subunit 7
  ENST ID: ENST00000475798
  CDS Start-End: 1-344
cagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacacctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcacca

SEQ ID NO: 143156 - DNA, 571 bp, Homo sapiens
  Payload ID: 8284
  Gene Symbol: INTS7
  Gene Name: integrator complex subunit 7
  ENST ID: ENST00000619805
  CDS Start-End: 94-222
aaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaagacggtgtcacctcacctgtattccaaaatacctgaattctcagaccatcaagaaagtttgtcaagaaagaccacagattgcttttacattatcgatatggctcagatgttgttggtgtttcagtaaacaaatatgaggcctttggggaagtatcttcataggccctcctcaagagaaaggcctcagcagccagatttgttccaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgaga

SEQ ID NO: 143157 - DNA, 3434 bp, Homo sapiens
  Payload ID: 8285
  Gene Symbol: INTS8
  Gene Name: integrator complex subunit 8
  ENST ID: ENST00000343161
  CDS Start-End: 57-2333
caagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggtatgtattggagtgaactgctttcttttatcaaaaaattacgaggacagggtcttgatctgtcacccaagctggagtgctgaggtgaaccactcgttttgactattattttatcactctttgtgaaacttcacaatgttcgggaggacattgtgaatgatattacagctgaacacatttctatttggccatcttccattcccaaacatcacgttgctttgtcgcccaggctggagtgcagtggtgaggtctcagctcactgcaacctacgcctgcaaggttcaagcgattctcatgcctcagcctgccaagtatctgggattacagcctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcaca

SEQ ID NO: 143158 - DNA, 3272 bp, Homo sapiens
  Payload ID: 8285
  Gene Symbol: INTS8
  Gene Name: integrator complex subunit 8
  ENST ID: ENST00000524333
  CDS Start-End: 134-1009
tgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggtatgtattggagtgaactgctttcttttatcaaaaaattacgagaaccactcgttttgactattattttatcactctttgtgaaacttcacaatgttcgggtaagtatttcataatttcatttagaaaaatttaaaagaaatttctttgtaaatcacacctttttttttctttttaaaggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaa

SEQ ID NO: 143159 - DNA, 581 bp, Homo sapiens
  Payload ID: 8285
  Gene Symbol: INTS8
  Gene Name: integrator complex subunit 8
  ENST ID: ENST00000519457
  CDS Start-End: 143-581
attttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagggcaattaggacaattgttcaaagtagttttccagtcaaacaggcaaaacccggaccccctcagttaagtgttatgaatcaaatgcaacaggaaaaagagctaacagaaaacattttgaaagtgctcaaagaac

SEQ ID NO: 143160 - DNA, 569 bp, Homo sapiens
  Payload ID: 8285
  Gene Symbol: INTS8
  Gene Name: integrator complex subunit 8
  ENST ID: ENST00000519053
  CDS Start-End: 287-569
ttgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaag

SEQ ID NO: 143161 - DNA, 735 bp, Homo sapiens
  Payload ID: 8285
  Gene Symbol: INTS8
  Gene Name: integrator complex subunit 8
  ENST ID: ENST00000522171
  CDS Start-End: 122-735
gttaaataggtaactgcaaggaggtgatatgaatgccatgaccgggatgcacagctctatggccacatacaacagggtgcctacctgtccaaggaggtagtgaagaccgcagagaaaagtcatgtttgatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccga

SEQ ID NO: 143162 - DNA, 3351 bp, Homo sapiens
  Payload ID: 8285
  Gene Symbol: INTS8
  Gene Name: integrator complex subunit 8
  ENST ID: ENST00000523206
  CDS Start-End: 57-932
caagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaaacatcacgttgctttgtcgcccaggctggagtgcagtggtgaggtctcagctcactgcaacctacgcctgcaaggttcaagcgattctcatgcctcagcctgccaagtatctgggattacagcctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcaca

SEQ ID NO: 143163 - DNA, 597 bp, Homo sapiens
  Payload ID: 8285
  Gene Symbol: INTS8
  Gene Name: integrator complex subunit 8
  ENST ID: ENST00000523808
  CDS Start-End: 10-597
gctcaccgtatgctgccatccgtccaggaagcgagtgggaagctggtgttctcggcaggacggcgggagcatctgaggagaggacccaggtgcgaggaaatctcagaaatgggaacggggaaattgaaagcacaggagataaactttgcttgggtcacaactagaacccttcgcttcgcctttacgaaaatattgaggcccgttgcaaccctagatgaggttgtctcattttctcgctggagaactgtcagggaacacggaaaacccacccgcgacccggcttcatgcggcgccgtctcctatggcaaccgggaggaggcgtggttcgaagatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctg

SEQ ID NO: 143164 - DNA, 548 bp, Homo sapiens
  Payload ID: 8285
  Gene Symbol: INTS8
  Gene Name: integrator complex subunit 8
  ENST ID: ENST00000521860
  CDS Start-End: 1-548
gaacaacgattggtccgaaggcgcggcggtggcgcggggaggcggatccaggaccgcagctccggctggcccgcgccgccattttggattgtatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctg

SEQ ID NO: 143165 - DNA, 2482 bp, Homo sapiens
  Payload ID: 8285
  Gene Symbol: INTS8
  Gene Name: integrator complex subunit 8
  ENST ID: ENST00000520526
  CDS Start-End: 1-2402
aggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataata

SEQ ID NO: 143166 - DNA, 4633 bp, Homo sapiens
  Payload ID: 8285
  Gene Symbol: INTS8
  Gene Name: integrator complex subunit 8
  Uniprot ID: Q75QN2
  ENST ID: ENST00000523731
  CDS Start-End: 134-3121
tgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaatctactttatgaggctggattttttttttagaaaagctaatttaaaatatttagaaatagctagcctatgtacagcaagttttcatgtctttttttaataaatagatttctaggagtcagtatatatttaatactcttcttccttaagaaaatagaagtttaggtcaagtgttaagctttatcactttgacactgtccttatctcacaatggaggaatttagaaaggaccttaacagtttcacaaacataaataaagccttagtcacactaaattaaaaaaaaaaattccttagggatatcttagagtagtaaagtgacttcctcatataaatagtttgaaagggtacttaagtttttcacccaaattgtgatatacaaaaaggttattaccaagcaacctacatgtcaagaaagccccagttaggaaggagccacagcatttatcttgtttataatttctttggtactcccactgtttagagcacaggttgaacaccatgttcatctaagccttattagttaaaaaatgtgttatggcaaggcaaataaactagtttaaaaaacattaaatttcaccatttgtagaaattcaagttttataatagcttgctatagcagctatagataaattagtcaccttattacaaaactaaacctttgtaaacaagtttaaatttaattttcaagaaccaaattgcactagtcaagagtgtaggaattttgagaatctaacaactagattcaaagtactgtatcacttagtataccctttaaggtagcacttatccagtccaaaactccagtgacaaaattcctagtttatcaagataaacacagtaacactggattaaaggaaaaacattgctatggtatagactgtggttggcttctatccagtaaccttgggaatgaagacatctttgtaaacaagtcctgctgtttctttaacagctaacataggaaataattaaatgtattctttagtgccaattgtaagttttaaaatcagaatggcagtgtaacttgtgaattggctagggcaatcaatcacagcactactttctgtaaaactttagtagttcagtgataccagttctacccaatcttggtgaattccaacttgtttgcttagttatcttctttagtgttttcctggtggtttttcagtgctcttcggtggtgtcataatgcctccattgcacactggtgacaactgtcccccttttctgaaggtgtttatgtaatttacttcctcc

SEQ ID NO: 143167 - DNA, 487 bp, Homo sapiens
  Payload ID: 8285
  Gene Symbol: INTS8
  Gene Name: integrator complex subunit 8
  ENST ID: ENST00000520315
  CDS Start-End: 1-396
gaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgaggacagggtcttgatctgtcacccaagctggagtgctgaggaaccactcgttttgactattattttatcactctttgtgaaacttcacaatgttcgggaggacattgtgaatgatattacagctgaacac

SEQ ID NO: 143168 - DNA, 2759 bp, Homo sapiens
  Payload ID: 8286
  Gene Symbol: INTS9
  Gene Name: integrator complex subunit 9
  Uniprot ID: Q9NV88
  ENST ID: ENST00000416984
  CDS Start-End: 361-2274
gaaaggggagtcggagccgtcgggactacacatcccagaacaccatgggccccaggcccgtaaggaagacatgatatcatgctggggtggagagggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 143169 - DNA, 929 bp, Homo sapiens
  Payload ID: 8286
  Gene Symbol: INTS9
  Gene Name: integrator complex subunit 9
  ENST ID: ENST00000523436
  CDS Start-End: 28-929
ctgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtg

SEQ ID NO: 143170 - DNA, 2578 bp, Homo sapiens
  Payload ID: 8286
  Gene Symbol: INTS9
  Gene Name: integrator complex subunit 9
  ENST ID: ENST00000523303
  CDS Start-End: 32-1609
gtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagactgcagtgatgtaaatacagattaaaggaagagtaatggtcatcattaaaggcccccagcctgaactgcgccctttgctttcagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 143171 - DNA, 756 bp, Homo sapiens
  Payload ID: 8286
  Gene Symbol: INTS9
  Gene Name: integrator complex subunit 9
  ENST ID: ENST00000518510
  CDS Start-End: 46-558
gtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatgg

SEQ ID NO: 143172 - DNA, 2544 bp, Homo sapiens
  Payload ID: 8286
  Gene Symbol: INTS9
  Gene Name: integrator complex subunit 9
  Uniprot ID: Q9NV88
  ENST ID: ENST00000521022
  CDS Start-End: 83-2059
gcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 143173 - DNA, 559 bp, Homo sapiens
  Payload ID: 8286
  Gene Symbol: INTS9
  Gene Name: integrator complex subunit 9
  ENST ID: ENST00000520184
  CDS Start-End: 298-559
ttcctgggtttgaggagttcagtgactgctattgaaccaccaaaagtccattatgaaactgtctcataaccctcagtagatgatatgctgcttggtgacagaggaagaaaactggaattgcacaaagagcatcgctggaggccacagggtctgggccctttgcaagcgcctcctgtacaagtgtgtgaacctcaggcagccactctgtgctcccgtgcactcagttgacccacgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccat

SEQ ID NO: 143174 - DNA, 668 bp, Homo sapiens
  Payload ID: 8286
  Gene Symbol: INTS9
  Gene Name: integrator complex subunit 9
  ENST ID: ENST00000524081
  CDS Start-End: 1-668
cccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttc

SEQ ID NO: 143175 - DNA, 686 bp, Homo sapiens
  Payload ID: 8286
  Gene Symbol: INTS9
  Gene Name: integrator complex subunit 9
  ENST ID: ENST00000517383
  CDS Start-End: 1-452
tgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagatctcacagatgtgcagtctgcccagcccacctctttcttttcttctggagcagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctct

SEQ ID NO: 143176 - DNA, 416 bp, Homo sapiens
  Payload ID: 8286
  Gene Symbol: INTS9
  Gene Name: integrator complex subunit 9
  ENST ID: ENST00000520437
  CDS Start-End: 1-78
attatgttggactgcggactggacatgacttctaccctcaatttccttcctttgccacttgttcaaagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaatt

SEQ ID NO: 143177 - DNA, 2045 bp, Homo sapiens
  Payload ID: 8286
  Gene Symbol: INTS9
  Gene Name: integrator complex subunit 9
  ENST ID: ENST00000522363
  CDS Start-End: 61-177
gaagacgcttcctgggtttgaggagttcagtgactgctattgaaccaccaaaagtccattatgaaactgtcccaggctgtccaatcttcctggctggtccctgaaggatggaaatgctttcttggacaagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaa

SEQ ID NO: 143178 - DNA, 2430 bp, Homo sapiens
  Payload ID: 8286
  Gene Symbol: INTS9
  Gene Name: integrator complex subunit 9
  Uniprot ID: Q9NV88
  ENST ID: ENST00000521777
  CDS Start-End: 138-2042
cagtgactgctattgaaccaccaaaagtccattatgaaactggtgagtcttcgctcctaggtcagagggcaaagtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacg

SEQ ID NO: 143179 - DNA, 3400 bp, Homo sapiens
  Payload ID: 8287
  Gene Symbol: ITFG1
  Gene Name: integrin alpha FG-GAP repeat containing 1
  Uniprot ID: Q8TB96
  ENST ID: ENST00000320640
  CDS Start-End: 230-2068
actgtcgggaggcgcgcctgccggaagtgagcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaa

SEQ ID NO: 143180 - DNA, 1849 bp, Homo sapiens
  Payload ID: 8287
  Gene Symbol: ITFG1
  Gene Name: integrin alpha FG-GAP repeat containing 1
  ENST ID: ENST00000544001
  CDS Start-End: 292-1686
actgtcgggaggcgcgcctgccggaagtgagcgtgagggcggctttcaccctagctccactgcttttttagcgtcggaagggcagccctagtgggagagagaaaaaggagccggcagcggctcttacgcgtcccggggctgcgcgccactctctcggccggaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatg

SEQ ID NO: 143181 - DNA, 550 bp, Homo sapiens
  Payload ID: 8287
  Gene Symbol: ITFG1
  Gene Name: integrin alpha FG-GAP repeat containing 1
  ENST ID: ENST00000563730
  CDS Start-End: 330-550
acaatgcaaagttaaacaaaacaccagccgggtactcaggcctgggcccaccaaagaagaaataaagacataatgatatcttatagtgaaatcaaccttcagaaacaaaggtatttaaaattaccaagtgacccttttggggtctacaacacttaccagaccttaagaaagcggaagacggagagacgactgcatcaggaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagg

SEQ ID NO: 143182 - DNA, 584 bp, Homo sapiens
  Payload ID: 8287
  Gene Symbol: ITFG1
  Gene Name: integrin alpha FG-GAP repeat containing 1
  ENST ID: ENST00000565262
  CDS Start-End: 1-537
gtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagtt

SEQ ID NO: 143183 - DNA, 2663 bp, Homo sapiens
  Payload ID: 8287
  Gene Symbol: ITFG1
  Gene Name: integrin alpha FG-GAP repeat containing 1
  ENST ID: ENST00000565940
  CDS Start-End: 1-341
ttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggaggccataccaccctgaacgcgccccatctcttctgatctcggaagctaaccaaggtcagacctggttagtgcttggatgggagatcacctattactttttctgtaggtttttaataaagaatatgggtgctttgatgctagtaatagtgaactttgaaataattattgtgaatcctgaatgagaaacctgtttttttctccaaaatttgaaaaatatcttgaagagagtcttgctttagagacaaattggaaggagatcctgatttgcttttgtggccgtatccaagaggaattgagtgcaggtggggtgcagggaaaacacagtccactccccaccaccactccgctccttccacagcaaatggggactgctcagaaaaccctgtcctttcttttcctctcttcaaaggcaggcatgtgattgaggatgtgatggtgacttctggcctgttttattttgtggtaacttcactttagtcagggaaataattggaatatctttaatctgatgtagtttgacctttagaaattgaaagtgaaacagctattgttgataattcacaaagtattaataaaacttctattacctgtacagattttttacttaatctgcgagaaaactatttagaatattatggaattgtgccatagcttctttatttgttcttaattctatattagatttttttttctctgcttcatgaacaagttcagattttaaaacatcatgcctgaagacatgtccaactttattttttatatgttatattctggtccaatatactagagtaataatactctggtattttaggatatctgtcatttgaacctcagttacaaattaaacaatagtagctaaccatatctaagtgataagtttgcatctaagatttgtcctgatgccagtttgaagatatataagctgacagaaatttgcattgtttagaatgactgtagtctaacaatatcatggttcagacaacagaaagctgaatatgcccctgtggcagcaaatattaatatgttactaaaatatgaaaactacgtttaagcaatgtcagttttataaacaacagataagatatgtacataggtgagtaagtgaaaaagtcatcagcattgacattttgggttattcacgtgaccttgattggcagcctaatcttttatttatcaagaaatctaccttttacaacttaaatattatgctttatggatatgccaaacccaagattatctttaattgaatttgaccagcgctttggtttgggaagcatgcaatgatctttaaattcagtgtgaaatgcttctgtagaattatagcagaaagcccttgctataacctggcttagtgcagacatgcaaatctgagatagcacaaccagtttggctggactaaaggtgcagatgatcagtctaaacagcagtggtgataagcagaagaattccttataattggtacagtggggttatctaacagggacaggaagggcactcactgcatctaatgaggttcaggaggtaattgaagtgtgttaaatggtcaaaggtgagacttcagtttgagcttcaacttcacttataatgacttgaaataatgtaataatgtgccatattacttagaaataacacctagctgttaagtgtcacagcagcttctgcagtgatgtgacgttattgataatgagcattttctataagaggacattggaaactgatgttgcatactcattcagaatattgtttttaatgttgaagtgaaaacacttgtacctgtaattttagtcaaaaccaaatataatgttggtctgttaaaattttctgactcaaaaaaaaaaaaaaaaaaaaaaattttctgactcacgtactgagttcaaatacgttctgggtcaggcccaagttgtatacttggagatattaatgtaggtatgtgacagatatatactttgccgtacactgtttacatcacaagtgatcgcatgaaaatattgaatgtggtataagtagcactgaaagcaatcatttttaactgttgtgtgggtagattttgcccctccattatcaaaaaaactgtattctctatttaaatgtagtcagctactatcaatccagaagaaataaatctgcatttttccatttagcctttcatattttctcacattataaccaatgactgatttattaaatcacccttcagttttactgttgattttgtttgtttgctgatacattacagaaaatattataaatatttgttttaatgaagtgtgacattgtatcacttaaatctattgtttagtaagaatatgaaaattatgatgaggtttataacacaaaataaaaccaaataatactcaa

SEQ ID NO: 143184 - DNA, 2361 bp, Homo sapiens
  Payload ID: 8288
  Gene Symbol: ITFG2
  Gene Name: integrin alpha FG-GAP repeat containing 2
  Uniprot ID: Q969R8
  ENST ID: ENST00000228799
  CDS Start-End: 140-1483
gaggaagaggcagagattggaggttcaggcagtgacgtaacttgctgccttaggtggccttccgctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagca

SEQ ID NO: 143185 - DNA, 715 bp, Homo sapiens
  Payload ID: 8288
  Gene Symbol: ITFG2
  Gene Name: integrin alpha FG-GAP repeat containing 2
  ENST ID: ENST00000534935
  CDS Start-End: 1-396
ggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcattta

SEQ ID NO: 143186 - DNA, 449 bp, Homo sapiens
  Payload ID: 8288
  Gene Symbol: ITFG2
  Gene Name: integrin alpha FG-GAP repeat containing 2
  ENST ID: ENST00000535564
  CDS Start-End: 1-53
aactggtggtgggagacaccagcgggaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgtttt

SEQ ID NO: 143187 - DNA, 292 bp, Homo sapiens
  Payload ID: 8288
  Gene Symbol: ITFG2
  Gene Name: integrin alpha FG-GAP repeat containing 2
  ENST ID: ENST00000538822
  CDS Start-End: 1-172
taccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggcgtctttggatcacactgcgcggctgctggctccatcacaaaacaatgaaggtaggcagt

SEQ ID NO: 143188 - DNA, 1935 bp, Homo sapiens
  Payload ID: 8288
  Gene Symbol: ITFG2
  Gene Name: integrin alpha FG-GAP repeat containing 2
  Uniprot ID: Q969R8
  ENST ID: ENST00000540929
  CDS Start-End: 69-512
ggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcggtgggcatgcctacctttgcaggcagccaggagagtaggagtcagtggatactagagcatatcccaagggattgggatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaagaatgcggacccagaatgattggagagcaagaagagcaatccacatagaagaagcacagagcaaagacggtggccgaggaccagtgggaatttattgcgaatgttcaatagtgactgagtggttaagtggttccagagattacagggccaatgccttagaacacatgagttttttccagaattacgttatccatgcacacacaccatttgtctgtgtagagcacactgaggagtacttacttaatttaagtattgtattttgaccaaggaaggggggcagagtaatggtggtgacagatggagttgcaccgaggagacatggcttggggcagggaggaaggaggtagaggatcctggttaggtccaggctagggagagaggtgcccttt

SEQ ID NO: 143189 - DNA, 559 bp, Homo sapiens
  Payload ID: 8288
  Gene Symbol: ITFG2
  Gene Name: integrin alpha FG-GAP repeat containing 2
  ENST ID: ENST00000540662
  CDS Start-End: 1-179
tgtactgggaggtgcagctggagcggatggagtctaccaatctggtgaaactgctggagaccaagccggagtaccacagcctgctgcaggagctgggcgtgggtgagtcccagaaaagccagtggcccgagtgcccaggagacccacagcatgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctggga

SEQ ID NO: 143190 - DNA, 1419 bp, Homo sapiens
  Payload ID: 8288
  Gene Symbol: ITFG2
  Gene Name: integrin alpha FG-GAP repeat containing 2
  ENST ID: ENST00000537851
  CDS Start-End: 77-247
gctctggcggctgtcgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtagggagaccccagctgcccgagacgtggtgctgcaccagacatctggccgtatccacaacaagaatgtctccactcacctaattggcaacatcaaacaaggccacggcactgagagtagtggctctggcctctttgccctgtgcaccctggatgggacactgaagctcatggaagaaatggaagaagcagacaagctgctgtggtcagtgcaggtggatcaccagctctttgccctggagaaactggatgtcaccggcaacgggcatgaggaggtagttgcatgcgcctgggatggacagacatatatcattgatcacaaccgcaccgtcgtccgcttccaagtggatgaaaatatccgtgccttctgtgcaggcctgtacgcctgcaaagagggccgcaacagcccctgcctcgtatatgtcactttcaaccagaagatctatgtgtactgggaggtgcagctggagcggatggagtctaccaatctggtgaaactgctggagaccaagccggagtaccacagcctgctgcaggagctgggcgtggatcctgacgacctccctgtgactcgtgccctgcttcaccaaacgctctaccatccagaccagccaccacagtgtgctccctcaagcctccaggatcccacctagctgtacttgcctcatagctggtgaaggattcttctgaacccccaccctaccccctaaaggtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgt

SEQ ID NO: 143191 - DNA, 1296 bp, Homo sapiens
  Payload ID: 8289
  Gene Symbol: ITGB1BP2
  Gene Name: integrin beta 1 binding protein (melusin) 2
  Uniprot ID: Q9UKP3
  ENST ID: ENST00000373829
  CDS Start-End: 74-1117
ctaagaggtgttccccattcggcagccagactccttgaaataccctttcagtaatcattcaaccaacgcttccatgtctctactctgtcgtaacaaaggctgtgggcagcactttgaccctaataccaaccttcctgattcctgttgccatcaccctggggtcccaatcttccatgatgcacttaagggttggtcctgctgccgaaagcgaactgtagatttctctgagttcttaaacatcaagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggatgaagtcttggagctgttgtggcatccagaccctggattttggggcattcttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaaggaggggagaacaaaattgtccaaaccatgctgtttttttcccttaaataaatcttgtattcttcagtttca

SEQ ID NO: 143192 - DNA, 1439 bp, Homo sapiens
  Payload ID: 8289
  Gene Symbol: ITGB1BP2
  Gene Name: integrin beta 1 binding protein (melusin) 2
  Uniprot ID: Q9UKP3
  ENST ID: ENST00000538820
  CDS Start-End: 341-1330
atcattcaaccaacgcttccatgtctctactctgtcgtaacaaaggctgtgggcagcactttgaccctaataccaaccttcctggtgagtaaagaatcctgacctggccaggggctctgtgtgggtgttggggactggtcagctggggggcagtgtgtttgaggagcggggaaagaaactacctgccctagtttaattggtctgagtgatcttacagcctttgctggcttttttttttttcttcacattatatgggaagaaaccataaatagaaacccggggaagaggtgaaaaatgatacttggtatagttatcttcccttccttgataacttctactgatgtccacagattcctgttgccatcaccctggggtcccaatcttccatgatgcacttaagggttggtcctgctgccgaaagcgaactgtagatttctctgagttcttaaacatcaagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtcagagttgcctctgaagctgctgccgctaaatatatcccaagccctggaaatggcattggaacagaaggaattagaccaggaacctggggcaggacttgacagtctgatccggactggttccagctgccagaacccaggatgtgatgctgtttaccaaggccctgagagtgatgctactccatgtacctaccacccaggagcaccccgattccatgaggggatgaagtcttggagctgttgtggcatccagaccctggattttggggcattcttggcacaaccagggtgcagagtcggtagacatgactgggggaagcagctcccagcatcttgccgccatgattggcaccagacagattccttagtagtggtgactgtatatggccagattccacttcctgcgtttaactgggtgaaggccagtcaaactgagcttcatgtccacattgtctttgatggtaaccgtgtgttccaagcacagatgaagctctggggggtcataaacgtggagcagagctctgtcttcttgatgccatctcgggttgaaatctccctggtcaaggctgacccaggatcctgggcccagctggagcaccctgatgcactagctaagaaggctagggcaggggttgtgttagagatggatgaggaagaatctgacgattcagatgatgatctgagctggacagaggaggaggaagaggaggaagcaatgggggaatagtgacaccagacagttgatgtctagataggacctcaatgattcccttagaatcttagataccaggatattgttggccatgtggcatcattgagcagcaggaggctgaagg

SEQ ID NO: 143193 - DNA, 1772 bp, Homo sapiens
  Payload ID: 8290
  Gene Symbol: ITGB1BP1
  Gene Name: integrin beta 1 binding protein 1
  Uniprot ID: O14713
  ENST ID: ENST00000238091
  CDS Start-End: 170-622
gcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacagtgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaa

SEQ ID NO: 143194 - DNA, 1963 bp, Homo sapiens
  Payload ID: 8290
  Gene Symbol: ITGB1BP1
  Gene Name: integrin beta 1 binding protein 1
  Uniprot ID: O14713
  ENST ID: ENST00000355346
  CDS Start-End: 211-813
gtcaggactgcgcctgcgcatagtcttggaggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacagtgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaa

SEQ ID NO: 143195 - DNA, 2126 bp, Homo sapiens
  Payload ID: 8290
  Gene Symbol: ITGB1BP1
  Gene Name: integrin beta 1 binding protein 1
  ENST ID: ENST00000359712
  CDS Start-End: 808-1362
gatgcctgggctcgggcttggttccgggcggggccgcgctcccggggcgcgggtggaggagcttggaaccacgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggtgagacttcgttactttggttagctgcttgcccatcaagtcgcaacacccagggactactgtttttgaaggctgaagaaatacaatccattatatatggaatatcttggcctggggatagtgaatgaatattaggccggaggtcagccggctggcaagacagtgcaggtttgtgaaatatttgttagggccagtggcagcactcgcttgtgccgggatttaaaaggtaaacaaagcagctgaggaaaaatgtatcctccaggggccgaaggcttcttccatttccgaacgttgttgccctcctagactgcgtgatcagcctttgcaggctgcagtcgctgtttgctttcctctgaaggagggcagaaagggcccacgtgcagggaagctcatagtatgggttccactgacccaggcaggcatgtgtggtcggcttgcttaggagaggtcttaagagggtcaggtgtgtgcctctgctagccaaattaagttcacgaagagacagatgaatgttgctcttactctatctttcatgtaatgtaggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtg

SEQ ID NO: 143196 - DNA, 4859 bp, Homo sapiens
  Payload ID: 8290
  Gene Symbol: ITGB1BP1
  Gene Name: integrin beta 1 binding protein 1
  Uniprot ID: O14713
  ENST ID: ENST00000360635
  CDS Start-End: 898-1500
ttccgggcggggccgcgctcccggggcgcgggtggaggagcttggaaccacgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacagtgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagtattttatttttttccagtcaaatgactagttaacaagaagagtaaacttattaaacatgctctaattataaatcactgcattaaggacaatgaaaataatcaatttcggttatacaatatatacagttgtgctgcaaccaaagtaatcaggtgaatgaactgaatatcatacatctcaaaatagcatcctaagctgcatattatgttatccaccccttaacagatcacacagttactcttagtctgtgtacatgttctgagccatcatcccagatctgatggagaatggcatgcaaaatgccagaatcctgcagctgcagttcatgaaacataaactttaaatataaatagatatctacaatgtttttctttctcttagttgcttttttaatttgcaaggagcaaataactaagaaaggatattagcagggtcgttaatataatttctcctctggtaagagtactattagttactgcacaatagcaccaaattgtagactggaaaaatatttcctaggtatttatgtaccagtgaacctgacagattagtttgggactggagttctaatgttgatatgaatcaactttattccttatatagctggcaccaggtggtcaaaaggctgactataaaatacagatgcaggaggattgttaaaatagacataagtgcactgtgcaaaatacatctgtttacttaaatctatgagaaaattaaatgaagggttcaaacagaaattaacaattagtgaaaacagatgtagtgctttaaaaaaaaacaaaaacaaaaaactacagatataacacatttttacccggaactttgaaaggtaaaaagcgattgctatacaacatcataaaacattccagtttgttctgtcttcctttataacaaaaacaaaaagtacaatgccaaaaaaaaaaaaaactctacacagtcttgcataataaagacaagctgcttcaatcaaatgcaccatcacaacaaatgcagttaacagcattgctgcctcactttccaagcctatatgcaaatttattcctttacttttgttaaaagtccaagtgggtatcatatgcctatttattctcagagtgccaaaatttccaatattcctactatgaatcttaccctcgcaattactaaatagaggtatgacagtcaagttcattaaacgaatgagttttggttttataatagacaacctaatcctctactaccaccccaagtagcttaagaatgatatgatggcctgaaacagtaaaaagtgggatgtttgggagtattacctgggacctatatatttctgatatgttcttgattataaacagatggacagattcaatttcaagacagtgtgactaccattcctgttggagtattatagaaatacaagacactaaactgagtaaacattctcctgggctagaagggaaggcagtggtacactcagtaggaaacagcaagtgatgtgttaatacagcatggtctgcgccacagaattctactgtgtacagttgctttctgtgtgactcaggaagttcaagaaggcaaattccaaaacacctaaagcatataaactaatttaaaagaactgttttgcaatccatcatccttagtttttaaccaaattcaggaaatgcagttttatataacctggaacagaatgaactgtagttaccctacgttgtcataaaccatcagtagttttgttaagtatgattgttcacaacaggttatacatacatgcagaatataatgatagctgcaacctcacaaattagggctagaaagtacaatgctaatgtgtaaatttccaagttgctttttaaacactgggtggatttcaaaggaatgtgtgtctttaaaggtgaactgatggcattttatcgagaaagttcagagctgggctatggacttctgaagcagcagttcactggccgcctaaaataataattgtgataaaggtcaccaactccagaactgggccaaggaatgcaggaagaatttattcattaatgcaaacatttttaggtttagctaattccgtagaggcaggatcttgattatgtataatagttaaaataacttttcagttcacctgttgggaaattcagtttttcctaataaatgcatagcaatgtttcatgaaaaccacaaattataaaaacaattactgatatgtaaaaa

SEQ ID NO: 143197 - DNA, 1043 bp, Homo sapiens
  Payload ID: 8290
  Gene Symbol: ITGB1BP1
  Gene Name: integrin beta 1 binding protein 1
  ENST ID: ENST00000456913
  CDS Start-End: 94-648
cggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggtgagacttcgttactttggttagctgcttgcccatcaagtcgcaacacccagggactactgtttttgaaggctgaagaaatacaatccattatatatggaatatcttggcctggggatagtgaatgaatattaggccggaggtcagccggctggcaagacagtgcaggtttgtgaaatatttgttagggccagtggcagcactcgcttgtgccgggatttaaaaggtaaacaaagcagctgaggaaaaatgtatcctccaggggccgaaggcttcttccatttccgaacgttgttgccctcctagactgcgtgatcagcctttgcaggctgcagtcgctgtttgctttcctctgaaggagggcagaaagggcccacgtgcagggaagctcatagtatgggttccactgacccaggcag

SEQ ID NO: 143198 - DNA, 663 bp, Homo sapiens
  Payload ID: 8290
  Gene Symbol: ITGB1BP1
  Gene Name: integrin beta 1 binding protein 1
  ENST ID: ENST00000460001
  CDS Start-End: 411-663
agatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggc

SEQ ID NO: 143199 - DNA, 699 bp, Homo sapiens
  Payload ID: 8290
  Gene Symbol: ITGB1BP1
  Gene Name: integrin beta 1 binding protein 1
  ENST ID: ENST00000494563
  CDS Start-End: 358-699
agatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtt

SEQ ID NO: 143200 - DNA, 540 bp, Homo sapiens
  Payload ID: 8290
  Gene Symbol: ITGB1BP1
  Gene Name: integrin beta 1 binding protein 1
  ENST ID: ENST00000484735
  CDS Start-End: 281-540
gagctcgcggaggcctgacgggaacacggtcccgagagcggcgcggacggccaggaaggatgggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattaga

SEQ ID NO: 143201 - DNA, 659 bp, Homo sapiens
  Payload ID: 8290
  Gene Symbol: ITGB1BP1
  Gene Name: integrin beta 1 binding protein 1
  ENST ID: ENST00000497105
  CDS Start-End: 463-659
tccgggcggggccgcgctcccggggcgcgggtggaggagcttggaaccacgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaa

SEQ ID NO: 143202 - DNA, 861 bp, Homo sapiens
  Payload ID: 8290
  Gene Symbol: ITGB1BP1
  Gene Name: integrin beta 1 binding protein 1
  ENST ID: ENST00000464228
  CDS Start-End: 164-280
gtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtga

SEQ ID NO: 143203 - DNA, 874 bp, Homo sapiens
  Payload ID: 8290
  Gene Symbol: ITGB1BP1
  Gene Name: integrin beta 1 binding protein 1
  Uniprot ID: O14713
  ENST ID: ENST00000488451
  CDS Start-End: 255-707
agccggcgctggagcgggaacgggagtagctgcctgggcgccaaaggccgcggcactcccacgcggaccccgaagtccgcaacccggggatgggcccgcggctgcgaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattac

SEQ ID NO: 143204 - DNA, 445 bp, Homo sapiens
  Payload ID: 8290
  Gene Symbol: ITGB1BP1
  Gene Name: integrin beta 1 binding protein 1
  ENST ID: ENST00000467606
  CDS Start-End: 158-445
gcctcttcctctgccccgcttcggccgcctcccgcctctcagggtcggggttgtctgtccccttcgctgtcacatcctccgcacccagcgcttggaaggtgctccatcacggtgacagacaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccag

SEQ ID NO: 143205 - DNA, 748 bp, Homo sapiens
  Payload ID: 8290
  Gene Symbol: ITGB1BP1
  Gene Name: integrin beta 1 binding protein 1
  ENST ID: ENST00000492079
  CDS Start-End: 341-748
aaatatagaagtaaattggatgatgaggctgattaaaaagcttgggctcagtggtcagacttgggcaagtggcctaatgtcgtcccctagtaagtggacttagagtggggtctccaaatacggagaatctttgggttgcagcaggagctttcactgactgctgcgtgagttgctcgttctttttccttcatcaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctac

SEQ ID NO: 143206 - DNA, 1913 bp, Homo sapiens
  Payload ID: 8290
  Gene Symbol: ITGB1BP1
  Gene Name: integrin beta 1 binding protein 1
  ENST ID: ENST00000483795
  CDS Start-End: 120-443
agtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccaggtaaaaaaaaaaaattccgtaactctctggttatgagagtctggggagccaactcatggctttggggcaaaatgctcactcctcgggtccactgggtgccgctccgcttgctctcgactgaagtccccgcatcaccaccgcacatgtgcgtgagcgctgagctgcatgggaacacaggcgctgttcctcccttcaaacacgcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagactagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacagtgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacatt

SEQ ID NO: 143207 - DNA, 948 bp, Homo sapiens
  Payload ID: 8291
  Gene Symbol: ITGB3BP
  Gene Name: integrin beta 3 binding protein (beta3-endonexin)
  Uniprot ID: Q13352
  ENST ID: ENST00000271002
  CDS Start-End: 83-616
gtttcctttggcggattttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaagtg

SEQ ID NO: 143208 - DNA, 1044 bp, Homo sapiens
  Payload ID: 8291
  Gene Symbol: ITGB3BP
  Gene Name: integrin beta 3 binding protein (beta3-endonexin)
  Uniprot ID: Q13352
  ENST ID: ENST00000371092
  CDS Start-End: 62-712
gttttcggaagttgctgggttcgttttattcagcggcagtggtgctttcccgaatctcagaatgccttttgctcccgttgcccaggctagagtgcaatggcacgatttccgttcactgcaacatctgcttcccgcgttcaagcgattctcctgcctcagccttgggagtagttgggattacagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaagtg

SEQ ID NO: 143209 - DNA, 1285 bp, Homo sapiens
  Payload ID: 8291
  Gene Symbol: ITGB3BP
  Gene Name: integrin beta 3 binding protein (beta3-endonexin)
  Uniprot ID: Q13352
  ENST ID: ENST00000489099
  CDS Start-End: 370-882
aagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgcggggaggatgtttccgcccggccgcggtgggcttgacgcaacgtccagcgcgcgcttttcatgccttggcgtttcctttggcggattttctgttttcggaagttgctgggttcgttttattcagcggcagtggtgctttcccgaatctcagaatgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaattcatgatgttgctatcaaaagttgagaaattgtcagaagaaatcatggagataatgcaaaatttaagtagtatacaggctttggagggcagtagagagcttgaaaatctcattggaatctcctgtgcatcacatttcttaaaaagagaaatgcagaaaaccaaagaactaatgacaaaagtgaataaacaaaaactgtttgaaaagagtacaggacttcctcacaaaggtcagcctcagatgtcacaacctctgtgaagctctccccagctctcctagcatcacgtcatcttgacagctatgaattccttaaagccattttaaactgaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaagtg

SEQ ID NO: 143210 - DNA, 10757 bp, Homo sapiens
  Payload ID: 8292
  Gene Symbol: ITGA1
  Gene Name: integrin, alpha 1
  Uniprot ID: P56199
  ENST ID: ENST00000282588
  CDS Start-End: 459-3998
ctcccgaaggtccagcccttacccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggaattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgttgttctacgctgctgcgtatcattcaatgttgatgtgaaaaattcaatgactttcagcggcccggtggaagacatgtttggatatactgttcaacaatatgaaaatgaagaaggaaaatgggtgcttattggttctccgttagttggccaacccaaaaacagaactggagatgtctataagtgtccagttgggagaggtgaatcattaccttgtgtaaagttggatctaccagttaatacatcaattcccaatgtcacagaagtaaaggagaacatgacatttggatcaactttagtcaccaacccaaatggaggatttctggcttgtgggcccttatatgcctatagatgtggacatttgcattacacaactggaatctgttctgacgtcagccccacatttcaagtcgtgaattccattgcccctgtacaagaatgcagcactcaactggacatagtcatagtgctggatggttccaacagtatttacccatgggacagtgttacagcttttttaaatgaccttcttgaaagaatggatattggtcctaaacagacacaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaagccacagctgaccagtcagcagcttcatttgaaatggaaatgtctcagactggcttcagtgctcattattcacaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggttacactgtaaactctgctactgcttcttctggagatgtgctctatattgctggacagcctcggtacaatcatacaggccaggtcattatctacaggatggaagatggaaacatcaaaattctccagacgctcagtggagaacagattggttcctactttggcagtattttaacaacaactgacattgacaaggattctaatactgacattcttctagtcggagcccctatgtacatgggaacagagaaggaggagcaaggaaaagtgtatgtgtatgctctcaatcagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaacgtattccatcaggtggggatggtaagacactgaaattttttggccagtctatccacggagaaatggatttaaatggtgacggtctgacagatgtgactattgggggccttggtggtgctgccctcttctggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctgatttgcagtaccgtgtcaccctagattcactaagacaaatatcacgaagttttttctctggaactcaagagagaaaggttcaaaggaacatcacagttcgaaaatcagaatgcactaagcactccttctacatgttggacaagcatgactttcaggactctgtgagaataacgttggactttaatcttaccgatccagaaaatgggcctgttcttgatgattctctaccaaactcagtacatgaatatattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggctatccaaaaagacagttgtgaatctaatcataatatcacatgtaaagttggatatcccttcctgagaagaggagagatggtaactttcaaaatattgtttcagtttaacacatcctatctcatggaaaatgtgaccatttatttaagtgcaacaagtgacagcgaagaacctcctgaaaccctttctgataatgtagtaaacatttctatcccggtaaaatatgaagttggactacagttttacagctctgcaagtgaataccacatttcaattgctgccaatgagacagtccctgaagttattaattctactgaggacattggaaatgaaattaatatcttctacttgattagaaaaagtggatcttttccaatgccagagcttaagctgtcaatttcattccccaatatgacatcaaatggttaccctgtgctgtacccaactggattgtcatcttctgagaatgcaaactgcagaccccatatctttgaggatcctttcagtatcaactctggaaagaaaatgactacatcaactgaccatctcaaacgaggcacaattctggactgcaatacatgtaaatttgctaccatcacatgtaatctcacttcttctgacatcagccaagtcaatgtttcgcttatcttgtggaaaccaacttttataaaatcatatttttccagcttaaatcttactataaggggagaacttcggagtgaaaatgcatctctggttttaagtagcagcaatcaaaaaagagagcttgctattcaaatatccaaagatgggctaccgggcagagtgccattatgggtcatcctgctgagtgcttttgccggattgttgctgttaatgctgctcattttagcactgtggaagattggattcttcaaaagaccactgaaaaagaaaatggagaaatgaaatattttatgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttcccttggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaagagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatcacacctttgtatgtgcttctttgttcttgaagtagtcattatggttcattggaatctactgtagcataagctcctaggttgctccatttcttaggaaaatagcaatgaatgaatgtatagtagctgcatgtgtgaactactgctgtaaagtttgctgacatttctgcaacaacatttctccatctgatttaccagaacctgtaacaagaccagaacatgtattcatccagaaactcctgggctctgctttgttcaaagaggagcaaatccacatagaaattaaatgttataaatttatttttttaaactaatttccaaagaatttagctgaagactcagagtcagcctacctcttgactctccacatccgcatctaagatcctgaaggccaaaggaatgcgcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattgttaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggccaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatagatattgatagagaacatgttgtgtctatatacatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatatacatatatatatatatatatatacacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaatccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagtttttcaaaatagcatcctatgtacttttcatttcttccaacaaccctcaggcccccttttgccagttttctcccccaggggagattttcaagactactggagaaaaatctgttaataaaacatttgctctgagtaccagcttcagtgactcaatcatttatacaggatttcagtgttttgttctgcagcggtgttctaaagggttcacatagtataatggaggagggacaaagcagaatatacttccaagctggaacatctttaagacatttacaaactgttatgggacactatcagcaactacgcctggggaagctagcaggatttagctcttcaatggccctccaaatgcacccaacaatcgccaacctcacccatggaaatcatctaaaaaatgaaaagaagggccttaaagtcctcacatggatgctgtatttataactaaaatgtacagtttaattctaaatagcaggcttttaaatgcaaacagcttccaggtgagtcctctggctgccaatcagactgctgattctaaaccattctcacacagaatttctgaaaccaacaccaggtattaattgttaactgcagtgaaaggaaaccaaggcacattacaaaaggctaaatgctgctgtttctaagtggaagcactgttgaacaacactcttaggtggaataagaaaattagggttaaactgtaacattgtaatcggacgaacaaatcagcatctttgatcctcaggttaaaatttaatcttaaatttagaaattcaaagtaacagcctttaaccattaaccttgaggaaaatgtgaagtagcatctggagtctcttaagccccagccctgttgtcccctacagcatctccacccaggaagtccagttcctaactaatgggaatggatccttttcccattataaagggccgatgcttaacccttgaacccactactgttcttatgccccaagatctgcaccttacatcaggcacccgggaatgcttctcattgaaattttaccataccaaaaaatatgtaagggtgactcatcactcctaactttggactccttgctttgagatcggtatttttttctctctctttacatatagcaaaagctttccccagtagctgatgaatttagaactttatacaagactccctagcattttcctcctcccacaggctggagaatttcagtgctatgagactgggcagtaggagccagagccaatttgcaggatctcttttccttctgccttccagttggcttctcttctcagctgcgtggtggggatgatttggggtttcctcagcaaggccattctctgccttgtgcccatagcagggccttgggtggtgacatgttatctttgttggtgagcagacactcagagatcctttaattatctgacacaccagggaaatcttggcaatcaactaaggacctgtgacactcataactatgtttacatttggctttagcatatttcaggtaatatctttatgaaaaaaagatgaagtatggaattgtaggaactcttttgcaatagactgagatccaatgtttaaatctttttatttcagtttgatctgtgcctttagattggggacaaaattttaaaaacaaatcttccaaatgacaccacaatgaaagccagttgtggtcttgaaaaatctctctattgcattacttatcctcacccttgttttttaagaggtagagagagattactgggaagcagtgagccaacataattgtcctttcctctacagaatagctgtgcagaaggggaccaccacacttaggaccagtgccaggtgacaatctttccgtcatgctgctgcagcattttgcaccttgagagacaggaaaaaaaatgggggtgagggagtggaagatgatgaaactatttctcttttatgtctacatccttactcctcaaaatactttaagctcactcagaccccatataccctgcccacaatactaacacatgtactttgcataagtaaattgttgattaaataagagcaaaactatattcttatgtgtagattaaccaaggctaatttcctggagtttaatacactttggattcaagtaaaaacaatcacttaatgcagcaacatctcagaccctcttcactctagaaccgttttatacaagagaactcaacatttactgttttatttctgatattgcctgccattactcaggatgcaagagatgctctgcattccttattaggaaaaattggcctgtaaggagaatggtatactgcgtattactactgtgagactgtaaaattgttaatggacagtgtaaagaattgtattcattttattagcaagaaaaatattgcatacaagaactactgccctgaaatatccatcactccaatgaactgttctgcctgatctaacataaagttatatttcattgctcatttttttttgcctcactaaaatgactaacttaagggaatgtgcatttctacaagactttaattggataaactcattagaagaaaatgtttcgattgcattcaggaacaaagaagcataacctttgttgactcttgtaatttattatatgcttcatttaaacccattttgtaaagaaatcaggtaacagtcatttaatctgatataattagaaatagctgagagagtaaaaaagcattttgaatgtcctatgtatggcatatcctgtacaccaattgaaggtcagagctttggtatttttgtataattctgtcttatctggtgcatcagctgtgtattttacgtcaaggtaaatgagcatcctgttttatatgttaaattttaaaaatgactttttcaaagaag

SEQ ID NO: 143211 - DNA, 5269 bp, Homo sapiens
  Payload ID: 8293
  Gene Symbol: ITGA10
  Gene Name: integrin, alpha 10
  Uniprot ID: O75578
  ENST ID: ENST00000369304
  CDS Start-End: 176-3679
gttttccttggtctggggctccccacagttccccaccatcactcctcccattccttccaactttatttttagctgccattgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggcctgtgcccctctctggtctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcattgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatga

SEQ ID NO: 143212 - DNA, 4735 bp, Homo sapiens
  Payload ID: 8293
  Gene Symbol: ITGA10
  Gene Name: integrin, alpha 10
  Uniprot ID: O75578
  ENST ID: ENST00000539363
  CDS Start-End: 77-3151
gggaaagtgaagaaaacagaaaaggagagggacagaggccagaggacttctcatactggacagaaaccgatcaggcatggaactccccttcgtcactcacctgttcttgcccctggtgttcctgacaggctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcattgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtc

SEQ ID NO: 143213 - DNA, 3955 bp, Homo sapiens
  Payload ID: 8294
  Gene Symbol: ITGA11
  Gene Name: integrin, alpha 11
  Uniprot ID: Q9UKX5
  ENST ID: ENST00000315757
  CDS Start-End: 97-3663
gtgcaggctgcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtg

SEQ ID NO: 143214 - DNA, 10192 bp, Homo sapiens
  Payload ID: 8294
  Gene Symbol: ITGA11
  Gene Name: integrin, alpha 11
  Uniprot ID: Q9UKX5
  ENST ID: ENST00000423218
  CDS Start-End: 97-3666
gtgcaggctgcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgggtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaacctgtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggtggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccatgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaaccaagcactgacatcccattctgtgggcagagcatatcacagtgagccatactcccctttgaaggagaggaagtagaatgagggagttccttgcttcctcccccctacctctacatgtcagaagggactcatccaccatttgctgcccacaacatgccctcctagtggctgcctggcctccgtgtgacgtctccagtggtggagcgctccctctcccaagatcacccttccatctatggccagtgtggacggttaggacctaaatgtttcactgtagcttctgcccttggttccagctcttccctctcacgcctcccagacttctccaggccggtttcattgttaaccgtcttacactctgacatcagccaaggcgtctccattctgttcttgtgccattcatgtcttggattcccagtaagtagaaccttggaaataatttgatcttgtttttgcataaatgaggacactcagaaccaggaagagccctaggctcccacagcaaaaccaaaactaaacccaggactgctatttcccaagccagattctgttattcgagcccagccttagaagggcttgatgtggagcaaaaggtgaaaatggtgaaactaaaatttgagtatcaaaacccattgccttctaatagaatcagaaggaaatgttgctaaatcatattccatttccgtcatcactcttatgaatggggtaacctggctaaatgagaattaatgaacccacactcataagttttcattgacttagcaccaagtcgtccatcaaatatcatcagatctgagaatgctcttatggatatctgatttttagaggctggcattcatatttttaaaaactgccacctgtgaccacactgcaggccaaacagaatgtacctgctggtcagatgcagcccagaggtcactgaattgcaacctctggactctcggtcagaggcaagcagcccttattccagaactccacagtccttcacacccttccccagacctacaccaagaccaactaagtggtcaaaaggtggacaaactgagagttgtatcaaggcccttagcctctcaatttgttatcaagtttccctttctgaatctatttaccctgaagtataaatacccaagatgagccttaagagtgcctggtagagcaaacaaagatgcatcttatagggagcaaagtctatgctaacgcagtgtttctcaatcctggctgcacctttgaaccacgggagctttaaaagtgaccactgcaagggccctacccactatggatcccaatttcattggttgggagaggggccaagtttgtttccaacttccccagatgactctaatggctgagagttgcaatcaacaggtaagtgaatatccaggctgtaagatgaagaaagagggggttgtgcccaagcccactgtgcctcataaagcagatgatctctgcagcgctgcgcttctcaaagagtggtcccaggactgcctcagtcagaccacagactcctaagttcctcctcagacttcatggatccaagctctgtgaggtaattctaagcacattaaacttgtagaacagccatctggatttaatattacataatagctataatattctgctattctctaatcttcaatgtcagtttcttaaactgtcaggcctgtctttagatgcccttcaactgtgctggggactatcttgatggcagccagcaaagaaaatcagcaaaaaccccagtggagtttctgggttttacttttgttaaggaaggtgatggtttcttgacatgacaggtatctaggtggaaagggcaaagtgctaatgcaaacacaatggagacactatggaatagctctgcctagggacatgtggaagagcttctaggagacagtgtggacctttccatccctagaggtcttcacaagataaattcctacctccgtcagtattcaaaaggttttagcatcaatactgtctgagaataagacattagacttgagtcagtcccctggcttcaatcccaggatgccaagcagcctctaatggagaccgctggcttaatcgtgctcctttcctggcataacaactcactgcacccatgcctcaccaccacgaagcagtctcctcaccacccaaatgtgccttgggtgacttaaatacagccattagtatgaatggtcccctgtttttattcaacaccacaccagtctttgcttttaccttcggctaatgtggttccagccttttatcctgcactccttcttataatttaaaaaaaaaaaaaactcccctactatctttatgttaatattaacatcaactaggttcttctcaaaggacagccaggcctaactggccacgttaaaatctgcacagtgcttttgtgtcactgtctattctattagtttcaacatcatgctaaaataggacagcatgttccaaaactgaaactgaaacaggaacggagccttgctgatttagcatgaggagggaattgtaagccttgcacctggacactaaaacttttcaataagatgtatgctaagccgtacctagcaaacttaccaggtccaaagtagagtacaagcagaaagttatttttaaaggatgggcactatccttgagggacttaccctttctaatcagctttgcatggtttgttttgagacagtgtctcactctgttgcccaggctagagtgcagcggcaccatcacagctcacggcagcctctgcctcccgggctcaagcaatcccacctcagtttcccaagtagctgggactacaggcacacaccacactcagctaattttagtattttttgtagagacagggtctcgccatgttgcccaggctggtctcaaactcctggattatctccctggccctgcattaaaaaagatgtgcaacaacttagtgatgtgtctgaaatgttttcagaaggtggcccaagtcagagtcaaaaaatttttttatttggaaaattagaggaaatacagaaaatcaaatttcaaatagatgcatctaaatggagaacaagcttatcaaggacagagtccatctttcttatttttatttttgagacagggtcttgctctgtcacccaggctagagtgcagcggcacaatcacagctccctgcagcctcgacctcctggacttcagtgatcctcccacctcagcctcttgagtagctgggactacagacatgcaccaccatgcccagctaattttttttttaattttgtgcagagagggggtctcactttgttgcccacactggtctctcttatttttgtatgcatatctgtggtgcagtgcctgaaatacagtaggtgttcaataagcgccaacatgcaagagtatcttgccattgattaaggcaaaagcaaaaccccagtccgcccctctgatggactgagcacaccaaatttctaaagcacaggcaaattagaaaatataattttgtctaaacttgccaacaagctaaggttttgtgaaccacctaaaatttgcctctctcatactgaaattttctaggtcaagtatctgaaggaatacactactgccagtattttctttggtgatctgtcatatacagcagacattacttgaaacaaagaaaaaaatgttttaaaacctgtctggatgatttccgcagtctcactaggttattgcagccagggagtgacctagcagagatctgaaggtgagcttccctagtactggcatctcacagtgaaagagcactgttcagtgggtcaagagacccagagcctactctcagttacgacacacatagtccttgtgtggcctttctgggcttgtgtcctgaactataaaatgagagggtggcactaaatgtttttttcagatctctatagaggctggaatggccacagagaatctaaatttgaaaacaaacatgtcctgagggtgtgctccaataccaccctttaatactctcctgagatgtgaaggctggaaatgagaatgccatattattgttacttgcaaacgattagtgtatctgggacatccaaaagaagtaactgaaaatttatttctttaaaaacaaaaaaaaccattacagtgcttttgtaaaaacattaatatttagaagtacgtagtggtaataaaaggaaaatagttgtaagaccttcattaaaaagaaaaacctaaaaaaaaaaacaaaacaaaactctggatacaggtgtatgatttacctaaccagacatagctttcttttggataaaaaaaaaaaaaaaaaaaaagctcagaagtgcagaactgtacagatgtccctaaatctattaattcaatgctaaacgaaataatctcttaacatgataaaattacaccaaacttcatctggaaaaataaacacgtaataatgaaaaaagttagccactcccacctccccacttaaaaaagacaaatgaagaaatactagtccaaggccaggtgtggtggctcacatctgtaatcccaacactttgagaggctgaggtgggaggactgcttgaacccaggagttcaagaccagcctaggcatcatggcaaaaccccatctctacaaaaaataccaaaataaaaagaattagctgggcatggtggcacatacctgtagtcccagctacttgggaggctgaggtgagaggatcacttgagcccggaagatcaaggcgacagtaagccatgatggcaccactgcactccagcctgggtgacagaatgaaaccctgtctcaaaaaacaaacaaacaaaaaccaaacaaattataggaaaatcaacattttaaaccaaagaagagaaggagaaagaagggaagggaagccataaaagtgtctttttcaaatagatcatgggggaaaaaaaaaaaaagtatgacttggaatagagacagccttacaagcaggatctaaaactcagaatccatttttttaaattgtgataaatttgactatagaaaaatgtaaactttggatacaaaagtaccatatttaaagtaaataagctacaactattacatgacagagaaaatgtcctcaaacttctaaggaacttctaacaagtagaaaaaaaacacacacaaccccaaagcaaacaccaatagtcaataaatatatgaaagtgttcaatgttactcataataaaggcatacaaatcaaacc

SEQ ID NO: 143215 - DNA, 7869 bp, Homo sapiens
  Payload ID: 8295
  Gene Symbol: ITGA2
  Gene Name: integrin, alpha 2 (CD49B, alpha 2 subunit of VLA-2 receptor)
  Uniprot ID: P17301
  ENST ID: ENST00000296585
  CDS Start-End: 144-3689
ttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaagttgcagaattcatttgatttatgagaaacaaaaattaaattgtagtcaacagttagtagtttttctcatatccaagtataacaaacagaaaagtttcattattgtaacccacttttttcataccacattattgaatattgttacaattgttttgaaaataaagccattttctttgggcttttataagtta

SEQ ID NO: 143216 - DNA, 3501 bp, Homo sapiens
  Payload ID: 8295
  Gene Symbol: ITGA2
  Gene Name: integrin, alpha 2 (CD49B, alpha 2 subunit of VLA-2 receptor)
  ENST ID: ENST00000513685
  CDS Start-End: 30-194
gcaactacggtcccccggtcagacccaggatggggccagaacggacaggggccgcgccgctgccgctgctgctggtgttagcgctcagtcaaggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccaggg

SEQ ID NO: 143217 - DNA, 3530 bp, Homo sapiens
  Payload ID: 8295
  Gene Symbol: ITGA2
  Gene Name: integrin, alpha 2 (CD49B, alpha 2 subunit of VLA-2 receptor)
  ENST ID: ENST00000510722
  CDS Start-End: 30-2858
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttg

SEQ ID NO: 143218 - DNA, 3487 bp, Homo sapiens
  Payload ID: 8295
  Gene Symbol: ITGA2
  Gene Name: integrin, alpha 2 (CD49B, alpha 2 subunit of VLA-2 receptor)
  ENST ID: ENST00000509814
  CDS Start-End: 30-2477
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcagttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctg

SEQ ID NO: 143219 - DNA, 3674 bp, Homo sapiens
  Payload ID: 8295
  Gene Symbol: ITGA2
  Gene Name: integrin, alpha 2 (CD49B, alpha 2 subunit of VLA-2 receptor)
  ENST ID: ENST00000509960
  CDS Start-End: 30-1955
gcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagctgttgtgtactataatttcgtgtcaaacctgctcttttagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttg

SEQ ID NO: 143220 - DNA, 3782 bp, Homo sapiens
  Payload ID: 8295
  Gene Symbol: ITGA2
  Gene Name: integrin, alpha 2 (CD49B, alpha 2 subunit of VLA-2 receptor)
  ENST ID: ENST00000503810
  CDS Start-End: 130-657
accgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagcgtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggg

SEQ ID NO: 143221 - DNA, 3333 bp, Homo sapiens
  Payload ID: 8296
  Gene Symbol: ITGA2B
  Gene Name: integrin, alpha 2b (platelet glycoprotein IIb of IIb/IIIa complex, antigen CD41)
  Uniprot ID: P08514
  ENST ID: ENST00000262407
  CDS Start-End: 33-3152
attcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcggagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccct

SEQ ID NO: 143222 - DNA, 281 bp, Homo sapiens
  Payload ID: 8296
  Gene Symbol: ITGA2B
  Gene Name: integrin, alpha 2b (platelet glycoprotein IIb of IIb/IIIa complex, antigen CD41)
  ENST ID: ENST00000588098
  CDS Start-End: 1-97
ggtgcccccgctcagcctgccccgaggggaagctcaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 143223 - DNA, 496 bp, Homo sapiens
  Payload ID: 8296
  Gene Symbol: ITGA2B
  Gene Name: integrin, alpha 2b (platelet glycoprotein IIb of IIb/IIIa complex, antigen CD41)
  ENST ID: ENST00000587295
  CDS Start-End: 1-313
gaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctga

SEQ ID NO: 143224 - DNA, 3665 bp, Homo sapiens
  Payload ID: 8297
  Gene Symbol: ITGA3
  Gene Name: integrin, alpha 3 (antigen CD49C, alpha 3 subunit of VLA-3 receptor)
  Uniprot ID: P26006
  ENST ID: ENST00000007722
  CDS Start-End: 1-3201
atgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcc

SEQ ID NO: 143225 - DNA, 4888 bp, Homo sapiens
  Payload ID: 8297
  Gene Symbol: ITGA3
  Gene Name: integrin, alpha 3 (antigen CD49C, alpha 3 subunit of VLA-3 receptor)
  Uniprot ID: P26006
  ENST ID: ENST00000320031
  CDS Start-End: 331-3486
agatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgt

SEQ ID NO: 143226 - DNA, 1817 bp, Homo sapiens
  Payload ID: 8297
  Gene Symbol: ITGA3
  Gene Name: integrin, alpha 3 (antigen CD49C, alpha 3 subunit of VLA-3 receptor)
  ENST ID: ENST00000506401
  CDS Start-End: 52-480
tttttctctttccccggaaggaaagcgcagcccgggctgggctcgcaagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcagtgagtgctggggtgcagcgtaaaaggggtacgctcccctgtccccttgctgaccaccctgtctacctgtagccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtc

SEQ ID NO: 143227 - DNA, 518 bp, Homo sapiens
  Payload ID: 8297
  Gene Symbol: ITGA3
  Gene Name: integrin, alpha 3 (antigen CD49C, alpha 3 subunit of VLA-3 receptor)
  ENST ID: ENST00000510809
  CDS Start-End: 1-253
catcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcggtgagccaggagggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccg

SEQ ID NO: 143228 - DNA, 827 bp, Homo sapiens
  Payload ID: 8297
  Gene Symbol: ITGA3
  Gene Name: integrin, alpha 3 (antigen CD49C, alpha 3 subunit of VLA-3 receptor)
  ENST ID: ENST00000506827
  CDS Start-End: 1-664
gagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 143229 - DNA, 351 bp, Homo sapiens
  Payload ID: 8297
  Gene Symbol: ITGA3
  Gene Name: integrin, alpha 3 (antigen CD49C, alpha 3 subunit of VLA-3 receptor)
  ENST ID: ENST00000512553
  CDS Start-End: 1-351
tgggacttatctgagtatagttacaaggacccagaggaccaaggaaacctctatattgatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgca

SEQ ID NO: 143230 - DNA, 227 bp, Homo sapiens
  Payload ID: 8297
  Gene Symbol: ITGA3
  Gene Name: integrin, alpha 3 (antigen CD49C, alpha 3 subunit of VLA-3 receptor)
  ENST ID: ENST00000504417
  CDS Start-End: 1-89
cccccgttgtcaccaacgtgactgtgaaggcacgagtgtggaacagcaccttcatcgagcatccagcacaggacctgacgcagaaatgaatgaacaaataaatgaatgatgcgcatttgtgtgtggaggggaggcctggctgacagatcctttggggattacagagactttgaccgagtccgggtaaatggctgggctaccctattcctccgaaccagcatccccac

SEQ ID NO: 143231 - DNA, 2070 bp, Homo sapiens
  Payload ID: 8298
  Gene Symbol: ITGA4
  Gene Name: integrin, alpha 4 (antigen CD49D, alpha 4 subunit of VLA-4 receptor)
  ENST ID: ENST00000233573
  CDS Start-End: 228-2070
ccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaa

SEQ ID NO: 143232 - DNA, 1403 bp, Homo sapiens
  Payload ID: 8298
  Gene Symbol: ITGA4
  Gene Name: integrin, alpha 4 (antigen CD49D, alpha 4 subunit of VLA-4 receptor)
  Uniprot ID: P13612
  ENST ID: ENST00000339307
  CDS Start-End: 449-1036
gctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaaggtagcatcagcaagtacagagctaggacataacagaagtgagcagaattggggtgaatgtcaacagagcatgtcagaggatatctgcagcaaaactaaaatccaacaatgcgtctttaggagctaagaaacatatgaatgcaaattcataattttctaaccaccctcactcaaaaaaaatccctcagcacgcaaagaaaaattttattggttggcaaaactttggccaagtatttgagttcaattatgggtgctaataagactttggtctttcttccttggaatgtgatgtcacagagcagcttatattacatatattcctattttgccttcggatacccaaaagataaaaaagtgaatattgattctcagttgcaataaaactcagtcttgatttctg

SEQ ID NO: 143233 - DNA, 4189 bp, Homo sapiens
  Payload ID: 8298
  Gene Symbol: ITGA4
  Gene Name: integrin, alpha 4 (antigen CD49D, alpha 4 subunit of VLA-4 receptor)
  Uniprot ID: P13612
  ENST ID: ENST00000397033
  CDS Start-End: 431-3529
gccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctattgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaattacttctgga

SEQ ID NO: 143234 - DNA, 4444 bp, Homo sapiens
  Payload ID: 8299
  Gene Symbol: ITGA5
  Gene Name: integrin, alpha 5 (fibronectin receptor, alpha polypeptide)
  Uniprot ID: P08648
  ENST ID: ENST00000293379
  CDS Start-End: 263-3412
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaa

SEQ ID NO: 143235 - DNA, 1240 bp, Homo sapiens
  Payload ID: 8299
  Gene Symbol: ITGA5
  Gene Name: integrin, alpha 5 (fibronectin receptor, alpha polypeptide)
  ENST ID: ENST00000435631
  CDS Start-End: 23-436
aggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacgggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccag

SEQ ID NO: 143236 - DNA, 1013 bp, Homo sapiens
  Payload ID: 8299
  Gene Symbol: ITGA5
  Gene Name: integrin, alpha 5 (fibronectin receptor, alpha polypeptide)
  ENST ID: ENST00000553071
  CDS Start-End: 1-361
gctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctg

SEQ ID NO: 143237 - DNA, 757 bp, Homo sapiens
  Payload ID: 8299
  Gene Symbol: ITGA5
  Gene Name: integrin, alpha 5 (fibronectin receptor, alpha polypeptide)
  ENST ID: ENST00000547197
  CDS Start-End: 1-359
aacgggaagctccaagccgcagctctgcttcctcgggacctcagatcctgcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtc

SEQ ID NO: 143238 - DNA, 5618 bp, Homo sapiens
  Payload ID: 8300
  Gene Symbol: ITGA6
  Gene Name: integrin, alpha 6
  Uniprot ID: P23229
  ENST ID: ENST00000264107
  CDS Start-End: 235-3456
ttgataaaacgcctgcgagtctccagagaacaacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagc

SEQ ID NO: 143239 - DNA, 3544 bp, Homo sapiens
  Payload ID: 8300
  Gene Symbol: ITGA6
  Gene Name: integrin, alpha 6
  Uniprot ID: P23229
  ENST ID: ENST00000409532
  CDS Start-End: 214-3078
acgtcgtggcttccgggcaggtaccgggcagctggagacgccagagccggcgggttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgtt

SEQ ID NO: 143240 - DNA, 5306 bp, Homo sapiens
  Payload ID: 8300
  Gene Symbol: ITGA6
  Gene Name: integrin, alpha 6
  Uniprot ID: P23229
  ENST ID: ENST00000409080
  CDS Start-End: 1-3276
atggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaa

SEQ ID NO: 143241 - DNA, 853 bp, Homo sapiens
  Payload ID: 8300
  Gene Symbol: ITGA6
  Gene Name: integrin, alpha 6
  ENST ID: ENST00000416789
  CDS Start-End: 1-777
acaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaa

SEQ ID NO: 143242 - DNA, 3261 bp, Homo sapiens
  Payload ID: 8300
  Gene Symbol: ITGA6
  Gene Name: integrin, alpha 6
  Uniprot ID: P23229
  ENST ID: ENST00000458358
  CDS Start-End: 1-3261
atggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatag

SEQ ID NO: 143243 - DNA, 3393 bp, Homo sapiens
  Payload ID: 8300
  Gene Symbol: ITGA6
  Gene Name: integrin, alpha 6
  Uniprot ID: P23229
  ENST ID: ENST00000442250
  CDS Start-End: 1-3393
atggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatag

SEQ ID NO: 143244 - DNA, 970 bp, Homo sapiens
  Payload ID: 8300
  Gene Symbol: ITGA6
  Gene Name: integrin, alpha 6
  ENST ID: ENST00000412899
  CDS Start-End: 278-970
aattctgtccacagagggcggcgcagtggggctgcttcgccgcgagctcgcctccggggctcccacgtcgtggcttccgggcaggtaccgggcagctggagacgccagagccggcgggttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatgga

SEQ ID NO: 143245 - DNA, 4120 bp, Homo sapiens
  Payload ID: 8301
  Gene Symbol: ITGA7
  Gene Name: integrin, alpha 7
  Uniprot ID: Q13683
  ENST ID: ENST00000257879
  CDS Start-End: 217-3630
gccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 143246 - DNA, 4084 bp, Homo sapiens
  Payload ID: 8301
  Gene Symbol: ITGA7
  Gene Name: integrin, alpha 7
  ENST ID: ENST00000347027
  CDS Start-End: 203-3598
tgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 143247 - DNA, 3763 bp, Homo sapiens
  Payload ID: 8301
  Gene Symbol: ITGA7
  Gene Name: integrin, alpha 7
  Uniprot ID: Q13683
  ENST ID: ENST00000452168
  CDS Start-End: 143-3277
gacacagagtgagtagacaaggcttcacatactgggagatctggctgggcttcaagagagggggttggtggtggtgtggctaagttccaaatgttggcctgaagccagtgctcaaagaaagggggcccttgagacagtccaaatggctccctttgccactcccatggttcaagctttgactacaaccagaattcagaggcaggcagaaggattccagtgctggagagaatgtggaacaaggagatctccatttgagggcaaggaaacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 143248 - DNA, 576 bp, Homo sapiens
  Payload ID: 8301
  Gene Symbol: ITGA7
  Gene Name: integrin, alpha 7
  ENST ID: ENST00000557257
  CDS Start-End: 117-576
agctttgactacaaccagaattcagaggcaggcagaaggattccagtgctggagagacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgt

SEQ ID NO: 143249 - DNA, 558 bp, Homo sapiens
  Payload ID: 8301
  Gene Symbol: ITGA7
  Gene Name: integrin, alpha 7
  ENST ID: ENST00000556273
  CDS Start-End: 134-430
accgctgtgtcacgtgaggttgggaaccgccctcttgagaccttgggtgaagatcttggcggggaagagaggtagagggttgcggagggcaggtgaagtgttctttattgggagcttagtttttgccactcccatggttcaagctttgactacaaccagaattcagaggcaggcagaaggattccagtgctggagaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggata

SEQ ID NO: 143250 - DNA, 1965 bp, Homo sapiens
  Payload ID: 8301
  Gene Symbol: ITGA7
  Gene Name: integrin, alpha 7
  ENST ID: ENST00000554327
  CDS Start-End: 1-328
tgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatgagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 143251 - DNA, 561 bp, Homo sapiens
  Payload ID: 8301
  Gene Symbol: ITGA7
  Gene Name: integrin, alpha 7
  ENST ID: ENST00000555809
  CDS Start-End: 132-278
ggtaagtgacctcccagtccttctcaagtgttaagggtttcttttggatcgtcaaagaccggagcggtcaagctgtttccccactgaattccctcaatcacatttatgttcttttcctcccagccactcccatggttcaagctttgactacaaccagaattcagaggcaggcagaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggcca

SEQ ID NO: 143252 - DNA, 817 bp, Homo sapiens
  Payload ID: 8301
  Gene Symbol: ITGA7
  Gene Name: integrin, alpha 7
  ENST ID: ENST00000557555
  CDS Start-End: 1-617
gctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagtgtggcttcttccatcggagcagccagagctcatcttttcccaccaactatcaccgggcctgtctggctgtgcagccttcagccatggaagttgggggtccagggactgtgggatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgg

SEQ ID NO: 143253 - DNA, 573 bp, Homo sapiens
  Payload ID: 8301
  Gene Symbol: ITGA7
  Gene Name: integrin, alpha 7
  ENST ID: ENST00000555687
  CDS Start-End: 13-180
gagacagtccaaatggctccctttgccactcccatggttcaagctttgactacaaccagaattcagaggcaggcagaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttg

SEQ ID NO: 143254 - DNA, 552 bp, Homo sapiens
  Payload ID: 8301
  Gene Symbol: ITGA7
  Gene Name: integrin, alpha 7
  ENST ID: ENST00000554724
  CDS Start-End: 1-106
agaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgagggcacagctgccgccttctcccctgatagccactacctcctctttggggccccaggaacctataattggaagggtgagtcactcctcgggaaggggagaaggggaccaaaacctcctcttacctcagagacagggttggggatggcacatggccaagcatgaccacatgtgcactgctgtatggccccagggcactgccatgccttccaccccattgagctagtgcacacatgaatggggggtgcctcctttccctcgcacggccaagtgttcctcaacatgctggcatgggccccaagt

SEQ ID NO: 143255 - DNA, 3935 bp, Homo sapiens
  Payload ID: 8301
  Gene Symbol: ITGA7
  Gene Name: integrin, alpha 7
  Uniprot ID: Q13683
  ENST ID: ENST00000553804
  CDS Start-End: 20-3445
ctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 143256 - DNA, 3930 bp, Homo sapiens
  Payload ID: 8301
  Gene Symbol: ITGA7
  Gene Name: integrin, alpha 7
  Uniprot ID: Q13683
  ENST ID: ENST00000555728
  CDS Start-End: 30-3575
tcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttgggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagg

SEQ ID NO: 143257 - DNA, 558 bp, Homo sapiens
  Payload ID: 8301
  Gene Symbol: ITGA7
  Gene Name: integrin, alpha 7
  ENST ID: ENST00000553893
  CDS Start-End: 121-267
gtgaggttgggaaccgccctcttgagaccttgggtgaagatcttggcggggaagagaggtagagggttgcggagggcaggtgaagtgttctttattgggagcttagtttttgccactcccatggttcaagctttgactacaaccagaattcagaggcaggcagaaggattccagtgctggagaggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaat

SEQ ID NO: 143258 - DNA, 6755 bp, Homo sapiens
  Payload ID: 8302
  Gene Symbol: ITGA8
  Gene Name: integrin, alpha 8
  Uniprot ID: P53708
  ENST ID: ENST00000378076
  CDS Start-End: 355-3546
gagatgggactgcaatagaaatccgggcagcccgaagaggcacccagcgctccagccaccagctgggccgcccgggagtccctggctctagaccagccgcgaggaggcgccgcgagagagctggtccctgcccgcggccggaggagggctagagcccctgggccagccccccgagccggctgggcgggcgggcgggtgggagcagacgccgggcactgtcaccacgggtgcgccgagcgcaccgacccgggacacgggcagctggggaccgccagattccaccagccccccttgccccgcaggggtcctcggctcgcgctcctgggtagcagccacccaccggggcggagggagatgtcgcccggggccagccgcggtccccggggaagccaggcgccgctgatcgcgcccctctgctgcgccgcggccgcgctggggatgttgctgtggtcccccgcctgtcaggcgttcaacctggacgtggaaaagctcacagtgtacagcggccccaagggcagctacttcggctacgccgtggacttccacatacccgacgcccgcacagcgagtgtcttggtgggggcgcccaaagccaacaccagccagcccgatatcgtggaagggggagccgtctattactgtccttggcccgcggaggggtctgcgcagtgcaggcagataccgtttgacaccaccaacaacagaaagatcagagttaatggaaccaaagaacctatcgagttcaaatccaatcagtggtttggagcaacagtgaaagctcacaaaggaaaagttgtggcctgtgctcctttatatcactggagaactcttaaaccgacaccagaaaaggacccagttggcacctgctatgtagcaattcagaacttcagcgcctatgccgagttctctccttgccggaacagcaatgctgatccggaaggccagggttactgccaagcaggatttagtctggatttttataagaatggagaccttattgtgggaggacctgggagtttctactggcaaggacaagtgatcactgccagtgttgcagatatcattgcaaattactcattcaaggatatcctcaggaaactggcaggagaaaagcagacggaagtggctccagcttcctatgatgacagttaccttggatactcagttgctgctggggagtttactggggattctcagcaagaattggttgctggaattccaagaggagcacagaattttggatatgtttccatcattaactctacggatatgacgtttattcagaatttcacgggagaacagatggcatcttattttggatataccgttgtcgtatcagatgttaacagtgatggactggatgatgtcctggttggggcacctctctttatggaacgtgaatttgagagcaaccccagagaagtagggcaaatctacctgtatttgcaagtgagctctctcctcttcagagacccccagatcctcactggcaccgagacgtttgggagattcggtagtgctatggcacacttaggagacctgaaccaagatggatacaatgacattgccatcggagtgccttttgcaggcaaggatcaaagaggcaaagtgctcatttataatgggaacaaagatggcttaaacaccaagccttcccaagttctgcaaggagtgtgggcctcacatgctgtcccttccggatttggctttactttaagaggagattcagacatagacaagaatgattacccagatttgattgtgggtgcatttggaacaggaaaagtcgctgtttacagagcaagaccggttgtgactgtagatgcccagcttctgctgcacccaatgattatcaatcttgaaaataaaacttgccaggttccagactctatgacatctgctgcctgcttttctttaagagtatgtgcatctgtcacaggccagagcattgcaaacacaatagtcttgatggcagaggtgcaattagattccctgaaacagaaaggagctattaaacggacgctcttccttgataaccatcaggctcatcgcgtcttccctcttgtgataaaaaggcagaaatcccaccagtgccaggatttcatcgtttaccttcgagatgaaactgaattccgagataaattatctccaatcaacattagtttgaattacagtttggacgaatccacctttaaagaaggcctggaagtgaaaccaatattgaactactacagagaaaacattgttagtgaacaggctcacattctggtggactgtggagaagacaatctgtgtgttcctgacttgaagctgtcggctagaccagataagcatcaggtaatcattggagatgaaaatcaccttatgctcataataaatgcaagaaatgaaggggaaggagcatatgaagctgaactctttgtaatgataccagaagaggcagattatgttggaatcgaacgcaacaacaagggatttcgaccactgagctgtgagtacaagatggaaaatgtaaccaggatggtggtgtgtgaccttgggaaccctatggtgtctggaacaaattattccctgggcctccgatttgcagttccacgtcttgagaaaacaaacatgagcattaacttcgatctccaaatcagaagttccaacaaggacaatccagacagcaattttgtgagcctgcaaatcaacatcactgctgtagcgcaggtggaaataagaggagtgtcacaccctccgcagattgttctgcccattcataactgggaaccagaagaggagccccacaaagaggaggaggttggaccattggtggaacatatttatgagctgcacaatattggaccaagtaccatcagtgacaccatcctggaggtgggctggcctttctctgcccgggatgaatttcttctctatattttccatattcaaactctgggacctctgcagtgccaaccaaatcctaatatcaatccacaggatataaagcctgctgcctccccagaggacacccctgagctcagcgcctttttgcgaaactctactattcctcatcttgtcaggaagagggatgtacatgtggtcgaattccacagacagagccctgcaaaaatactgaattgtacaaatatcgagtgtttacaaatctcctgtgcagtgggacgactcgaaggaggagaaagcgcagtcctgaaagtcaggtcacgattatgggcccacaccttcctccagagaaaaaatgatccctatgctcttgcatccctggtgtcctttgaagttaagaagatgccttatacagatcagccagcaaaactcccagaaggaagcatagtaattaagacatcagttatttgggcaactccgaatgtttccttctcaatcccattatgggtaataatactagcaatacttcttggattgttggttctcgccattttaaccttagctttatggaagtgtggattctttgacagagccagacctcctcaggaggacatgaccgacagggaacagctgacaaatgacaagacccctgaggcatgacaagaaaaaaaaagaagaccaaagacctcaaacactggtcctgttcaaagaaaaagaaagaacatgagggttaaaaatcaaagctttctgatacctgacagtgacccaggaaatggaggggaccctggaaacatcacctcatctacaccgcactttggagaaattgtcctgggtgcccagtgagccctgttggaaaaggaaacaccaaagctggagaagccatcagcaattgtggaagattttcttttgctttaatcgttctgtacttggcagacactttgaaatgcgtatgggaacgtaagttgcagtccagatcaatccagcataagttgcagagatgaaatgtctgaatcactatagaatttacaaggtgaactaaggtgaaatgactgatttactatagaacttagaactaagaccacaccatccaacactactgtatccaatggaacatttgacacctccctatggaaaagaaacatttctaaggacattatggctcagggagacaagcaatatgttgttggtactgtgaaagtacttttgaaaggacaaaaataatcttgtgagtgagggtgagagtttatttatttattttccatgtctctaggttgagaatctgtcatctagagaatttggaaattaagatttggttagctagttttcaaaatcactcactcagtttcctcctaagaaccactgtgtgcagataactcatttagcagagcttcttcagaatttagacagtgctaaggaaaggaagattggcattaggaatcagttctatttaataccttgctgccttccatctgaaattcctttcactcacattatccagggactcacatctgcttaatttagctttgcaagatgttgcatttatatttccttgtatatctttccattgacttagttaatacatgaatttcgaggtactctctacctttggagtgtttaaaagtcatggtaaaatgtctagagttcattaattaaaaagcaatttaacattatgggtaaacattatttttaatatctataagaagcaacacttcttatagatatttagcttgggattaaatacccgtttttcctgctatgccttgtacttgtatacacagagaaaacatgttgaatataacttagacaaaaacataaaattatacaggcatgagccaaactgggaaaactgattcctaaagatttttatttaaaattgcttattccaactttattacttatttttactgctaatctttataatatgtaactttggagaataatcttttatttaagctattttcccatcatcttgaatttaaccatcacaaattttttatgtttaaaactcttgtaaataattcataatcttgtaatattatcatttttgaagtaaaattgaccagccaaatttataggtagtctgcacaattttgtatccttttttaataatgaaaaattactatgaagaaatactgaacaaatttttatgtgcaatattttatagacctatgtatctgaagcatgtttacactggcgtttttttttttaattaatttcctaaatgttaagtatgatagaacaagctgacccaaatccttaagtttacaaagctgttggaaaactttgtgtcctgatttcaacaatcacgctttgtttgaaagatgagccaagctcacagacactaaattttatgtcatgccataagctggagaggagccatttggctacagctgcggaacttcattgaggagcaaatgaaaggcacatggacgagcacgctggtgcagttcatgttcttcctgcctgtgaattgaatactgtcctggtagcagtttcgggtcggtcaggagctcaaggctggtttgtgtggctgactacggatgagcactgaagttgcctcaaagaattaaggggtgtccacaccagcctctgggggtctttggtgttagtcttccaggtagagctggttttacaagtaggtggccatctacaggatgtgatgtgagcgatgccagacagctctctctgaccccaggtaatgccctgaatctggtgatcctggctgatctgtgaccaatagagattagctccttgggatttggggtcctaaaaggtccctgaaaaaatgcaccccttgtctttaagccaacattggtgaaggaactgagaactcttagggttacataaaaaaagacccctgttgagatagtttatgcagatacctggaaggaactagagatgccaggaggaagactgagacccagaatgaagcaaggcatgagggctccaaagtgaactgcaccatcccagagtctcagccaagatggccctttcctagagggacgggcaccttccacctgcccacaggcactgctacctatgggaattgcagaaggccgttgtacacacgcgcatgcacgcagtggccctctgccctttagaatatggaagcaaagtctgggtgcagtgactcacacttgtaatcccaacactttgggaggccgagacgggcagatcacctgagttcaggagttcaagaccagcctggccaacgtggcaaaaccccatctctactaaaaatacaaaaattagctgggcgtggtggcagtctcctgtaatcccagctacctaggaggctgaggcagagagagaatcgcttgaacccaggaggcggaggttgcagtgagctgagatcgcgcgactgcactccagcctgggcgacagagggaaactctgtctcaacaaaaaaataaataaaataaaaaataaaaaaagaatatggaagcaaatggagaaagggaggaaactgaggtcaggcaaaccttccagcaatccgttctgcccagagaacatactgacgacagagaacacactgagcgttatctgcttctagttagagcattgccgattgccttcataattcataatgtgctgtgctcctctgagggtctatctgtatttctcttcaaagaattccctttttaaattcttgcagctgggttttaagacacaataatggggcaaattaagttttataaacttggagatttttatacagtaaataaaaaaataatatgtactagtcacccctgaaactgcattcttagaactcgactcttgttttatttaaatacgtgcgtagatatctgtgaagattttcatgtacctatttaccttgtcactaataaaattaaaactgaaagacttga

SEQ ID NO: 143259 - DNA, 7889 bp, Homo sapiens
  Payload ID: 8303
  Gene Symbol: ITGA9
  Gene Name: integrin, alpha 9
  Uniprot ID: Q13797
  ENST ID: ENST00000264741
  CDS Start-End: 257-3364
ccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacgctgatcccttgctatgaagagtataagaagaagtacggagaggaacacggctcctgccaggctgggatagcgggcttcttcaccgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaagtatgaattcagcgtgatctttgatacaagccacctgtctggggaagaggaagttctcagcttcattgttactgctcagagtggcaacacggagcgctctgaatccctgcatgacaacaccctcgtgctgatggtgccactgatgcacgaggtggacacgtccatcaccggaatcatgtctccaacctcctttgtatatggcgagtccgtggacgcagccaacttcattcagctggatgacctggagtgtcactttcagcccatcaatatcacccttcaggtctacaacactggcccaagcacccttccagggtcatctgtcagcatctctttccctaatcgactctcatctggtggtgcagagatgtttcatgtccaggaaatggtggtgggccaagagaagggaaactgctctttccagaaaaacccaactccctgcatcatccctcaagaacaagaaaatatcttccacacaatatttgcttttttcacaaagtctggaagaaaagtcttggactgtgaaaaaccaggaatttcttgcctaacagcacactgtaactttagtgctcttgctaaagaagaaagtcgtactatagacatttacatgctgctgaacacagaaatactgaaaaaggacagttcgtctgtcatccagttcatgtcccgcgccaaggtgaaggtggatcctgccctaagggtggtggaaatagctcatgggaacccagaagaggtgacggtggtcttcgaggccctgcacaatctggagccccgtggctacgtcgtggggtggatcatcgccatcagtttgttggtgggaatcctcatcttcctgctgctggccgtgctgctctggaagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctgtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggaactccggaggaaaagttaggcctcagaggtgtcccaacctgaatcaaggggctggctgcacccagaggagatgtaaacgttttattctcaattcctgctggcgtaatggctccagtagctcaggacagtcctctaaaggacaaccacagatgcatcctcagccaggggagacacagggaaatgatgcaaaagaaatgatgcaaaggatctgagcagaacactgcccctccccaccccctgaatgtgtgagtgctgagttacggccttcagtatccaagctctctgtttgacagtagatatattgtcagatgcactgtgctgcttagttttgagtgcagtgtgattttctgaaagggcaatgagatgatggatgtagcatgctcagcactgacctggcccatagtgatcactcaataactgttaacagctatggctgctattcctactgatggataaccatctaataagacagaaaacatggggctaagagcagggtctaacggagtcttaatggcttattacagcctgccaaagtgccagctacatacacatggcatccagtgcggatgaaacaatctataaaaccaagggtctttcttatagcaccttttttactggaagctaacacgttgggagtccgtgaacattgtcaaaaagacatcaaactcaacttctgggaagacagatttttaatacacatacttggctaatactcacaaacatatctaaagttttggcaaaattatgagggtgatgggtgggtactaacctggcatggagcaggtgtgtcttttggtttcttatgcagttgactctgctgcagggagattacagatgtaacctcatgcttctcttcctggtgaacatgggaatagaccaaaaaaatcaagggtcaatggcatgaactaagctgatcctggaaatcagggatgttgcatctaactgtgggatggaggcacagaggtagctacagggagcaggacgaggcaaagaaagcagctgtcactcagagttcgcttatgagttttatcaaaagcagcaagaaaagcagtcttgggtgggttttatcacttattaacagccatttatgaggcccctgctgtgtgtcaggcactgtgcaaggtgctggaggttccccagagaacacttcagggacattttgcctcagggtggcaaaatgcagtggcatgtggactttttgaatgggatgccatttgcagctttcctttgatggactcttgttcataatgccatgttttctttaatgaatcatttaggattcttaggtgatatttctggaacagcaccatcaacagctttggccacatgcacttagagcaactaacttgcctcctgccggggtgtaggtgcgttggtgacagtgtagaagggtgattcgcaggcccatgttctgcccaccagcaaagccccactggagaagggtagactcctgtgggcagtctcagagctgggacctatttgcttctgcttgattctgcgtgggtggacccacatgagcagctgtatacccaggaggtcactaagactttataaaggcaggttttaagaaaaccagccttggcatcaccaccagcagatactgaaagcctccccaggaacctgtctggggaaggatgatgcctctgctggtctgatcgtgctgagtagcaggtgggctacggggactggggagttaagcattttgtgcagtgatagagaagtcaagcatatcgttagcgctctctcaacttgggcagttcacaagctccttcccagctcagaagccctctctatgctctcaggggaagcagatggggtggatcagtacatctgtgttacccttccagaatattatttgaaaattctacagtatgttctactttctccccttcctgcttccatggtttcactgtggaatcctataagatattctcctgagcagtattatttcagtttccttcagcttttagttgaatcttcaatgtggttttaaccaactgttcagagaactgaaatggtttttaaatatgaaaaaggacctttgtaaaaatggagtaaaacagtgccccttttttaaaaaaagttttgcttatgcttaatttacataggactcaggagagtttggaacatcctccaagtgggccatagagctgtcacaaagaagaggccatgatgtttagaaacaaggggacactagcaggaggggcagggtccactggcttagtggcaactgacaggcatccattccgaataactcagcactgaggtttcctcaggcagttctttaggaaaactgtcagcatcatgggtactcagaggtatggtagaccttgtagaagatccactaggaagtcctccttcaccaaatcatgtagctactgcccttgagccaaaggcaatgaggtttaaaacaaaaacccaacagcactcctgggaacatcctgttttccatgcggaagcatagcagatccccagacgatccgtgtgctgtatgctacctgttgaaccctagcatggtggctttttaaaaggttatttatgacttttatttttgggtaaggcattatggccaggtgcatgcagttatgtctgggttacgtgtgaaacgtacatctggtgaactgtatacttggctcaaacttctcaaaatttagaggtgctggaaaggattgtcacttggagcctttagtagacaaaaggcagaaagtgagcatcatttcagaaatgctttagtatgcacacttttagctgatattttgatatatagaataataatatacacagtggagaatattcaaagagtggctgaagggagaatacagagccagtagggccaaaatgaaacttctaggatgtcttctgaattttcagcacatggggggaataagtgaacaaatttcccaacatcgtgcaatgctttatagcacaatgatctagatttcagactgtgttaaggttttttctttgttgatgttgttgttttaattctaatgtgcacggtgtgactggcagagtgagtttaaaagctttacgagtgattaattgcttggcaggcacccacgctatctgcatttccagaactttactgatgcatccatgtacatttccactgaggaattttggtgggtggggggaggttgtgctgcctcacaatgtcacgtgtattaaagtctaagcagtcacttctgattcacttgcactgtttgggaaatgtcaggtttacaaaaacatacatgtttggaataaaaaatggctgcaaacaattcagaa

SEQ ID NO: 143260 - DNA, 2282 bp, Homo sapiens
  Payload ID: 8303
  Gene Symbol: ITGA9
  Gene Name: integrin, alpha 9
  ENST ID: ENST00000422441
  CDS Start-End: 261-2159
ccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacgctgatcccttgctatgaagagtataagaagaagtacggagaggaacacggctcctgccaggctgggatagcgggcttcttcaccgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacagagcagaaataatggcccaaaagttgagagagccgtgggcctggctgctcaggagaccgcagccaggacacacctcctctctgggtctcccttttctgatctgcaaaatgataaaataaacagtcttaggggtta

SEQ ID NO: 143261 - DNA, 609 bp, Homo sapiens
  Payload ID: 8303
  Gene Symbol: ITGA9
  Gene Name: integrin, alpha 9
  ENST ID: ENST00000411817
  CDS Start-End: 1-208
gaaaaaggacagttcgtctgtcatccagttcatgtcccgcgccaaggtgaaggtggatcctgccctaagggtggtggaaatagctcatgggaacccagaagaggtgacgatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaa

SEQ ID NO: 143262 - DNA, 3912 bp, Homo sapiens
  Payload ID: 8304
  Gene Symbol: ITGAD
  Gene Name: integrin, alpha D
  Uniprot ID: Q13349
  ENST ID: ENST00000389202
  CDS Start-End: 50-3535
ctgtgctctgtccccaaccttccacttcccctcaacgcgctgctcagggatgaccttcggcactgtgcttcttctgagtgtcctggcttcttatcatggattcaacctggatgtggaggagcctacgatcttccaggaggatgcaggcggctttgggcagagcgtggtgcagttcggtggatctcgactcgtggtgggagcacccctggaggtggtggcggccaaccagacgggacggctgtatgactgcgcagctgccaccggcatgtgccagcccatcccgctgcacatccgccctgaggccgtgaacatgtccttgggcctgaccctggcagcctccaccaacggctcccggctcctggcctgtggcccgaccctgcacagagtctgtggggagaactcatactcaaagggttcctgcctcctgctgggctcgcgctgggagatcatccagacagtccccgacgccacgccagagtgtccacatcaagagatggacatcgtcttcctgattgacggctctggaagcattgaccaaaatgactttaaccagatgaagggctttgtccaagctgtcatgggccagtttgagggcactgacaccctgtttgcactgatgcagtactcaaacctcctgaagatccacttcaccttcacccaattccggaccagcccgagccagcagagcctggtggatcccatcgtccaactgaaaggcctgacgttcacggccacgggcatcctgacagtggtgacacagctatttcatcataagaatggggcccgaaaaagtgccaagaagatcctcattgtcatcacagatgggcagaagtacaaagaccccctggaatacagtgatgtcatcccccaggcagagaaggctggcatcatccgctacgctatcggggtgggacacgctttccagggacccactgccaggcaggagctgaataccatcagctcagcgcctccgcaggaccacgtgttcaaggtggacaactttgcagcccttggcagcatccagaagcagctgcaggagaagatctatgcagttgagggaacccagtccagggcaagcagctccttccagcacgagatgtcccaagaaggcttcagcacagccctcacaatggatggcctcttcctgggggctgtggggagctttagctggtctggaggtgccttcctgtatcccccaaatatgagccccaccttcatcaacatgtctcaggagaatgtggacatgagggactcttacctgggttactccaccgagctagccctgtggaagggggtacagaacctggtcctgggggccccccgctaccagcataccgggaaggctgtcatcttcacccaggtgtccaggcaatggaggaagaaggccgaagtcacagggacgcagatcggctcctacttcggggcctccctctgctctgtggatgtggacagcgatggcagcaccgacctgatcctcattggggccccccattactatgagcagacccgagggggccaggtgtccgtgtgtcccttgcctagggggagggtgcagtggcagtgtgacgctgttctccgtggtgagcagggccacccctggggccgctttggggcagccctgacagtgttgggggatgtgaatgaggacaagctgatagacgtggccattggggccccgggagagcaggagaaccggggtgctgtctacctgtttcacggagcctcagaatccggcatcagcccctcccacagccagcggattgccagctcccagctctcccccaggctgcagtattttgggcaggcgctgagtgggggtcaggacctcacccaggatggactgatggacctggccgtgggggcccggggccaggtgctcctgctcaggagtctgccggtgctgaaagtgggggtggccatgagattcagccctgtggaggtggccaaggctgtgtaccggtgctgggaagagaagcccagtgccctggaagctggggacgccaccgtctgtctcaccatccagaaaagctcactggaccagctaggtgacatccaaagctctgtcaggtttgatctggcactggacccaggtcgtctgacttctcgtgccattttcaatgaaaccaagaaccccactttgactcgaagaaaaaccctgggactggggattcactgtgaaaccctgaagctgcttttgccagattgtgtggaggatgtggtgagccccatcattctgcacctcaacttctcactggtgagagagcccatcccctccccccagaacctgcgtcctgtgctggccgtgggctcacaagacctcttcactgcttctctccccttcgagaagaactgtgggcaagatggcctctgtgaaggggacctgggtgtcaccctcagcttctcaggcctgcagaccctgaccgtggggagctccctggagctcaacgtgattgtgactgtgtggaacgcaggtgaggattcctacggaaccgtggtcagcctctactatccagcagggctgtcgcaccgacgggtgtcaggagcccagaagcagccccatcagagtgccctgcgcctggcatgtgagacagtgcccactgaggatgagggcctaagaagcagccgctgcagtgtcaaccaccccatcttccatgagggctctaacggcaccttcatagtcacattcgatgtctcctacaaggccaccctgggagacaggatgcttatgagggccagtgcaagcagtgagaacaataaggcttcaagcagcaaggccaccttccagctggagctcccggtgaagtatgcagtctacaccatgatcagcaggcaggaagaatccaccaagtacttcaactttgcaacctccgatgagaagaaaatgaaagaggctgagcatcgataccgtgtgaataacctcagccagcgagatctggccatcagcattaacttctgggttcctgtcctgctgaacggggtggctgtgtgggatgtggtcatggaggccccatctcagagtctcccctgtgtttcagagagaaaacctccccagcattctgacttcctgacccagatttcaagaagtcccatgctggactgctccattgctgactgcctgcagttccgctgtgacgtcccctccttcagcgtccaggaggagctggatttcaccctgaagggcaatctcagtttcggctgggtccgcgagacattgcagaagaaggtgttggtcgtgagtgtggctgaaattacgttcgacacatccgtgtactcccagcttccaggacaggaggcatttatgagagctcagatggagatggtgctagaagaagacgaggtctacaatgccattcccatcatcatgggcagctctgtgggggctctgctactgctggcgctcatcacagccacactgtacaagcttggcttcttcaaacgccactacaaggaaatgctggaggacaagcctgaagacactgccacattcagtggggacgatttcagctgtgtggccccaaatgtgcctttgtcctaataatccactttcctgtttatctctaccactgtgggctggacttgcttgcaaccataaatcaacttacatggaaacaacttctgcatagatctgcactggcctaagcaacctaccaggtgctaagcaccttctcggagagatagagattgtaatgtttttacatatctgtccatctttttcagcaatgacccactttttacagaagcaggcatggtgccagcataaattttcatatgcttaagaattgtcacatgaaatgaggatgtttatagcacactttccttgcgtggaagagctataacccagggacctgagtgcctctctgggaatagtcgggggaacctatttgtgggcattgaaaaagttttttcactttc

SEQ ID NO: 143263 - DNA, 3858 bp, Homo sapiens
  Payload ID: 8305
  Gene Symbol: ITGAE
  Gene Name: integrin, alpha E (antigen CD103, human mucosal lymphocyte antigen 1
  alpha polypeptide)
  Uniprot ID: P38570
  ENST ID: ENST00000263087
  CDS Start-End: 100-3639
ccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacatcgcgggggctccacggtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgcgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgtagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgca

SEQ ID NO: 143264 - DNA, 416 bp, Homo sapiens
  Payload ID: 8305
  Gene Symbol: ITGAE
  Gene Name: integrin, alpha E (antigen CD103, human mucosal lymphocyte antigen 1
  alpha polypeptide)
  ENST ID: ENST00000574026
  CDS Start-End: 1-416
ccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaaggctcatgtttcagtcgtttggcagctagaggagaatgcctttccaaacaggacagcagacatcactgtgactgtcaccaaaccatccataatgtacgtgaacacaggccaggggctttctcaccacaaagaattcctcttccatgtacatggggaga

SEQ ID NO: 143265 - DNA, 5213 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  Uniprot ID: P20701
  ENST ID: ENST00000356798
  CDS Start-End: 181-3693
aggcacacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgcagggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccgtgacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtcca

SEQ ID NO: 143266 - DNA, 4673 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  Uniprot ID: P20701
  ENST ID: ENST00000358164
  CDS Start-End: 110-3370
gccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgcctgtctcctttgcaggctcatagggaagacctgctgagggaccagccaagagggctgcaaaagtgagggcttgtcattaccagacggttcaccagcctctcttggtttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgccacccctccttccttgaccagcagatcccagctcacgtcacacttggttgggtcctcacatctttcacacttccaccagcctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgatgcctcatgatatgtcagggcgtgggacatctagtaggtgcttgacataatttcactgaattaatgacagagccagtgggaagatacagaaaaagaggggctgggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaa

SEQ ID NO: 143267 - DNA, 1416 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENST ID: ENST00000433423
  CDS Start-End: 88-1302
ctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcagatcaagtctctcatcccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccgatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctgg

SEQ ID NO: 143268 - DNA, 821 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENST ID: ENST00000562857
  CDS Start-End: 93-581
ttttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcggggtagg

SEQ ID NO: 143269 - DNA, 536 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENST ID: ENST00000565864
  CDS Start-End: 93-260
ttttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacgggtgagatttctcaccagggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcagg

SEQ ID NO: 143270 - DNA, 561 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENST ID: ENST00000562652
  CDS Start-End: 120-392
actgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgagaggccaaacgggaagttgtatcctcaggccctgggaagagctttcagagctctaggggggccgggagttgctccttccatattcccagaagtcaacgccctggaggggaagcgcagggtgcgggtggcctggggagcgacatccgggtgggcctgggatcggccacctgctgggcacgtgcaggggcgggggtccctcggtcgcagctgacgacccttgccttcctcagcgccggcctcgagctacaacctggacgtgcggggcgcgcggagcttctccccaccgcgcgccgggaggcactttggataccgcgtcctgcaggtcggaaacgggttcctgacactcccttactcccctgcgagcgcctggaagccaggag

SEQ ID NO: 143271 - DNA, 699 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENST ID: ENST00000564118
  CDS Start-End: 89-699
cctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttgtttgctgctgttcagttttccacaagctacaaaacagaatttgatttctcagattatgttaaacggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcggggtagg

SEQ ID NO: 143272 - DNA, 559 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENST ID: ENST00000568926
  CDS Start-End: 94-423
attttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcagctggatggccaccggaccagaagacgggggttgttcccaggagggagacatgaactcagaaggaatatagctgtcaccaccagcatgtcatgcactgacttctcatttcatttcccgatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggctt

SEQ ID NO: 143273 - DNA, 575 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENST ID: ENST00000563615
  CDS Start-End: 1-116
tgaaagaaggagttaatatcacaatctgtttccagatcaagtctctcatcccccagttccaagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagct

SEQ ID NO: 143274 - DNA, 545 bp, Homo sapiens
  Payload ID: 8306
  Gene Symbol: ITGAL
  Gene Name: integrin, alpha L (antigen CD11A (p180), lymphocyte function-associated antigen 1
  alpha polypeptide)
  ENST ID: ENST00000569725
  CDS Start-End: 423-545
gaagagctttcagagctctaggggggccgggagttgctccttccatattcccagaagtcaacgccctggaggggaagcgcagggtgcgggtggcctggggagcgacatccgggtgggcctgggatcggccacctgctgggcacgtgcaggggcgggggtccctcggtcgcagctgacgacccttgccttcctcagcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcag

SEQ ID NO: 143275 - DNA, 3595 bp, Homo sapiens
  Payload ID: 8307
  Gene Symbol: ITGAM
  Gene Name: integrin, alpha M (complement component 3 receptor 3 subunit)
  Uniprot ID: P11215
  ENST ID: ENST00000287497
  CDS Start-End: 76-3534
tggcttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgt

SEQ ID NO: 143276 - DNA, 4718 bp, Homo sapiens
  Payload ID: 8307
  Gene Symbol: ITGAM
  Gene Name: integrin, alpha M (complement component 3 receptor 3 subunit)
  Uniprot ID: P11215
  ENST ID: ENST00000544665
  CDS Start-End: 72-3533
ttccttgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcaagtgtctgtgtgcaagtgtgtgcacatgtgtgcgtgtgcgtgcatgtgcacttgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggaacctcctccacaccagcgctgatgcccaataaagatgcccactgaggaatgatgaagcttcctttctggattcatttattatttcaatgtgactttaattttttggatggataagcttgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcatatatgtaaggataa

SEQ ID NO: 143277 - DNA, 494 bp, Homo sapiens
  Payload ID: 8307
  Gene Symbol: ITGAM
  Gene Name: integrin, alpha M (complement component 3 receptor 3 subunit)
  ENST ID: ENST00000567031
  CDS Start-End: 1-494
ataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttggatcggcgcctacttcggggcctccctctgctccgtggacgtggacagcaacggcagcaccgacctggtcctcatcggggccccccattactacgagcagacccgagggggccaggtgtccgtgtgccccttgcccaggggggacagatccagagtgttgtgacttatgacctggctctggac

SEQ ID NO: 143278 - DNA, 516 bp, Homo sapiens
  Payload ID: 8307
  Gene Symbol: ITGAM
  Gene Name: integrin, alpha M (complement component 3 receptor 3 subunit)
  ENST ID: ENST00000565142
  CDS Start-End: 1-354
gctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaaggtgctccccgctgctcccccaccccctcccttcatcctctcgggcctcgcgctgcagctccgtgcctcggtttccccggcggggctgccagctgtgtgactggggcgagtctgggagcctctctgcgcctcagtctcttagggagggtggccgggttcatgcgcggggcgcgctgagaacgagtcgccctccttgtagtttctgtttttctccaggccccgacgcggatgtcactcccctcccgccccgccctcctgggtc

SEQ ID NO: 143279 - DNA, 7030 bp, Homo sapiens
  Payload ID: 8308
  Gene Symbol: ITGAV
  Gene Name: integrin, alpha V
  Uniprot ID: P06756
  ENST ID: ENST00000261023
  CDS Start-End: 275-3421
cctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggtacca

SEQ ID NO: 143280 - DNA, 6903 bp, Homo sapiens
  Payload ID: 8308
  Gene Symbol: ITGAV
  Gene Name: integrin, alpha V
  Uniprot ID: P06756
  ENST ID: ENST00000374907
  CDS Start-End: 260-3298
ggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacgtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggt

SEQ ID NO: 143281 - DNA, 736 bp, Homo sapiens
  Payload ID: 8308
  Gene Symbol: ITGAV
  Gene Name: integrin, alpha V
  ENST ID: ENST00000430709
  CDS Start-End: 1-410
tgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggtaagtcattggtttaggcaaatagaataaatttactcaattcaaatgctgtacatgtttttattttgttttttaaagaacgacagcttaacttttttgataatttaaactaatgaagttatatgatagcattataacctagtttaatattatcattttactccttaccccgaagtgattaaagctagaccttttagtttagcatcttgtccagtgtaagagatttcttagtatatactaaattatattggagaaattttaggaattttcgtttacaaagttagaaagttggaaattaactgcaacaagtgaggcattttgaagatatttaaggagtaaaaatgggatcagcacat

SEQ ID NO: 143282 - DNA, 3288 bp, Homo sapiens
  Payload ID: 8308
  Gene Symbol: ITGAV
  Gene Name: integrin, alpha V
  Uniprot ID: P06756
  ENST ID: ENST00000433736
  CDS Start-End: 131-3139
ctttgtagctcctggagattcaattctttcttgccagggtctttctacctctgcctcacatattccctccatctcttcattccacttccctcatccccaccccccactcccctccatcctcaatacacaaatgctcctaggcaccctccttctgatcctgtacatcttaatgttgtgccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgt

SEQ ID NO: 143283 - DNA, 4703 bp, Homo sapiens
  Payload ID: 8309
  Gene Symbol: ITGAX
  Gene Name: integrin, alpha X (complement component 3 receptor 4 subunit)
  Uniprot ID: P20702
  ENST ID: ENST00000268296
  CDS Start-End: 122-3613
atgctgacaatcttcttccttcccctggccacctctctgcccacttgcttcctcagtaccttggtccagctcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcagctcaaaccccctcagcctgttggcttctgttcaccagctgcaagggtttacatacacggccaccgccatccaaaatgtcgtgcaccgattgttccatgcctcatatggggcccgtagggatgccgccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacagcgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgccgatgctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccagtgagaaatgatcccctctttgccttggacttcttctcccccgcgagttttccccacttacttaccctcacctgtcaggcctgacggggaggaaccactgcaccaccgagagaggctgggatgggcctgcttcctgtctttgggagaaaacgtcttgcttgggaaggggcctttgtcttgtcaaggttccaactggaaacccttaggacagggtccctgctgtgttccccaaaggacttgacttgcaatttctacctagaaatacatggacaatacccccaggcctcagtctcccttctcccatgaggcacgaatgatctttctttcctttctttttttttttttttcttttcttttttttttttttgagacggagtctcgctctgtcacccaggctggagtgcaatggcgtgatctcggctcactgcaacctccgcctcccgggttcaagtaattctgctgtctcagcctcctgagtagctgggactacaggcacacgccacctcgcccggcccgatctttctaaaatacagttctgaatatgctgctcatccccacctgtcttcaacagctccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgcatctaccgctcttgggaaatatgtcaaaggtctaaaaataaaaaagccttctgtg

SEQ ID NO: 143284 - DNA, 3990 bp, Homo sapiens
  Payload ID: 8309
  Gene Symbol: ITGAX
  Gene Name: integrin, alpha X (complement component 3 receptor 4 subunit)
  ENST ID: ENST00000562522
  CDS Start-End: 34-3543
ggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctggcctgcggccccaccgtgcaccacgagtgcgggaggaacatgtacctcaccggactctgcttcctcctgggccccacccagctcacccagaggctcccggtgtccaggcaggagtgcccaagacaggagcaggacattgtgttcctgatcgatggctcaggcagcatctcctcccgcaactttgccacgatgatgaacttcgtgagagctgtgataagccagttccagagacccagcacccagttttccctgatgcagttctccaacaaattccaaacacacttcactttcgaggaattcaggcgcagctcaaaccccctcagcctgttggcttctgttcaccagctgcaagggtttacatacacggccaccgccatccaaaatgtcgtgcaccgattgttccatgcctcatatggggcccgtagggatgccgccaaaattctcattgtcatcactgatgggaagaaagaaggcgacagcctggattataaggatgtcatccccatggctgatgcagcaggcatcatccgctatgcaattggggttggattagcttttcaaaacagaaattcttggaaagaattaaatgacattgcatcgaagccctcccaggaacacatatttaaagtggaggactttgatgctctgaaagatattcaaaaccaactgaaggagaagatctttgccattgagggtacggagaccacaagcagtagctccttcgaattggagatggcacaggagggcttcagcgctgtgttcacacctgatggccccgttctgggggctgtggggagcttcacctggtctggaggtgccttcctgtaccccccaaatatgagccctaccttcatcaacatgtctcaggagaatgtggacatgagggactcttacctgggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcagatcggctcctacttcggggcctccctctgctccgtggacgtagacagcgacggcagcaccgacctggtcctcatcggggccccccattactacgagcagacccgagggggccaggtgtctgtgtgtcccttgcccagggggtggagaaggtggtggtgtgatgctgttctctacggggagcagggccacccctggggtcgctttggggcggctctgacagtgctgggggatgtgaatggggacaagctgacagacgtggtcatcggggccccaggagaggaggagaaccggggtgctgtctacctgtttcacggagtcttgggacccagcatcagcccctcccacagccagcggatcgcgggctcccagctctcctccaggctgcagtattttgggcaggcactgagcgggggtcaagacctcacccaggatggactggtggacctggctgtgggggcccggggccaggtgctcctgctcaggaccagacctgtgctctgggtgggggtgagcatgcagttcatacctgccgagatccccaggtctgcgtttgagtgtcgggagcaggtggtctctgagcagaccctggtacagtccaacatctgcctttacattgacaaacgttctaagaacctgcttgggagccgtgacctccaaagctctgtgaccttggacctggccctcgaccctggccgcctgagtccccgtgccaccttccaggaaacaaagaaccggagtctgagccgagtccgagtcctcgggctgaaggcacactgtgaaaacttcaacctgctgctcccgagctgcgtggaggactctgtgacccccattaccttgcgtctgaacttcacgctggtgggcaagcccctccttgccttcagaaacctgcggcctatgctggccgccgatgctcagagatacttcacggcctccctaccctttgagaagaactgtggagccgaccatatctgccaggacaatctcggcatctccttcagcttcccaggcttgaagtccctgctggtggggagtaacctggagctgaacgcagaagtgatggtgtggaatgacggggaagactcctacggaaccaccatcaccttctcccaccccgcaggactgtcctaccgctacgtggcagagggccagaaacaagggcagctgcgttccctgcacctgacatgtgacagcgccccagttgggagccagggcacctggagcaccagctgcagaatcaaccacctcatcttccgtggcggcgcccagatcaccttcttggctacctttgacgtctcccccaaggctgtcctgggagaccggctgcttctgacagccaatgtgagcagtgagaacaacactcccaggaccagcaagaccaccttccagctggagctcccggtgaagtatgctgtctacactgtggttagcagccacgaacaattcaccaaatacctcaacttctcagagtctgaggagaaggaaagccatgtggccatgcacagataccaggtcaataacctgggacagagggacctgcctgtcagcatcaacttctgggtgcctgtggagctgaaccaggaggctgtgtggatggatgtggaggtctcccacccccagaacccatcccttcggtgctcctcagagaaaatcgcacccccagcatctgacttcctggcgcacattcagaagaatcccgtgctggactgctccattgctggctgcctgcggttccgctgtgacgtcccctccttcagcgtccaggaggagctggatttcaccctgaagggcaacctcagctttggctgggtccgccagatattgcagaagaaggtgtcggtcgtgagtgtggctgaaattacgttcgacacatccgtgtactcccagcttccaggacaggaggcatttatgagagctcagacgacaacggtgctggagaagtacaaggtccacaaccccacccccctcatcgtaggcagctccattgggggtctgttgctgctggcactcatcacagcggtactgtacaaagttggcttcttcaagcgtcagtacaaggaaatgatggaggaggcaaatggacaaattgccccagaaaacgggacacagacccccagcccgcccactccccattaccctcaggacaatgtctgaactctccagcttcgcgtgagaagtccccttccatcccagagggtgggcttcagggcgcacagcatgagaggctctgtgcccccatcaccctcgtttccagtgaattagtgtcatgtcagcatcagctcagggcttcatcgtggggctctcagttccgatttcccaggctgaattgggagtgagatgcctgcatgctgggttctgcacagctggcctcccgcgttgggcaacattgctggctggaagggaggagcgccctctagggagggacatggccccggtgcggctgcagctcacccagccccaggggcagaagagacccaaccacttctattttttgaggctatgaatatagtacctgaaaaaatgccaagacatgattatttttttaaaaagcgtactttaaatgtttgtgttaataaattaaaacatgcacaaaaagatgca

SEQ ID NO: 143285 - DNA, 1521 bp, Homo sapiens
  Payload ID: 8309
  Gene Symbol: ITGAX
  Gene Name: integrin, alpha X (complement component 3 receptor 4 subunit)
  ENST ID: ENST00000562918
  CDS Start-End: 82-627
ccacttgcttcctcagtaccttggtccagctcttcctgcaacggcccaggagctcagagctccacatctgaccttctagtcatgaccaggaccagggcagcactcctcctgttcacagccttagcaacttctctaggtttcaacttggacacagaggagctgacagccttccgtgtggacagcgctgggtttggagacagcgtggtccagtatgccaactcctgggtggtggttggagccccccaaaagataacagctgccaaccaaacgggtggcctctaccagtgtggctacagcactggtgcctgtgagcccatcggcctgcaggtgcccccggaggccgtgaacatgtccctgggcctgtccctggcgtctaccaccagcccttcccagctgctgctcacccagaggctcccggtgtccaggcagggtgagtgtcgggaccaccaaggctttgaggagctcacgcacatccaattgggggtgcggtgggctagagacagtcttgccagagtggatcagaaagaagggatctggaaaaagagttaccacgtgttgcagtggttcctgacgctgctgcccgcacatcctgccgatcgcccgcacgctgccggacctttcctgtgaccttaacctctccaagcctcagtttcttcatctgttggatggggataataacacacccagcactgaaagcaacacaggatgattcatggccaggggttagcacagcagctagcaccaggcgacagccccatgaaggccagctgttgttatttttagaggagaggatctattttcatccaatgggtcctgggatatgaccaattggtttgtgccgtagtttaggaaaggtcagtgaaagtgcagtgtgagcaacgtgtgtgtgtgtacatgtgtgtatatgtatgcatgtgtatacatgtgcacatgcacacatgtacatgcatgtgtgtgcatgtatgtgtgtgtgcgtgtgcacatgcaggttgagacgcagggcctgacttccctggtgctgatggggaagaaagataaggaagcaaaacagtgggctttggcaggctgaggcctccccctggtttcacatttgctctcaagcctttggtgagactgacatctggctgcaaatagggtgtgccttccagcacctccgtgggtccagactccatccacaggggcctgggcacccatcagaatgcccaggacacctgtctctccggtggaggcctctggggcagaggggatgcttgagaggtcacatggaagggggtttcctctccaggtgctggaagatcgtctcttctcaggacagatgctaacttcacacaggaggggagtgggggcctgtatttaagctgagaacagaacaggcccagtgtgtggctgttgcctgggatgatttgtttaaaatattaacaatcaaggcaagagggttgtttgaggcctggagtttgagaccagcctgggcaacatagtgagacctcatctctacaaaaaataaatataaaatacaaagta

SEQ ID NO: 143286 - DNA, 3640 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  Uniprot ID: P05556
  ENST ID: ENST00000302278
  CDS Start-End: 66-2462
agcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 143287 - DNA, 3784 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  Uniprot ID: P05556
  ENST ID: ENST00000396033
  CDS Start-End: 137-2533
gagccagcccagccgcgttccgaacgtgagggtcgccggcctgggcgctgtcacgtcggggctgccggagctgcgggggaccgggcccgaacggcccctgacacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagc

SEQ ID NO: 143288 - DNA, 3729 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  Uniprot ID: P05556
  ENST ID: ENST00000423113
  CDS Start-End: 1-2406
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagc

SEQ ID NO: 143289 - DNA, 445 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000437302
  CDS Start-End: 37-445
acacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaaga

SEQ ID NO: 143290 - DNA, 500 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000414670
  CDS Start-End: 354-500
gaacagcaggcccgagcccaccgcgccgggccccggacgccgcgcggaaaagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatggaaaggcaaaaaagtccgcaggcatagagagtggaaagaaggaacagcatactaggctggtttgaaaaacaatcaattgctagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcaca

SEQ ID NO: 143291 - DNA, 569 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000417122
  CDS Start-End: 301-569
agcccgcgggagaggcccagcgggagtcgcggaacagcaggcccgagcccaccgcgccgggccccggacgccgcgcggaaaagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaa

SEQ ID NO: 143292 - DNA, 552 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000475184
  CDS Start-End: 179-552
agtgcaaacgcagtgagtcatccgcagggcgtgcggagtgtgccggctgggtccctgcagcccccaagcccggagggatgcgggaaaatcgctcttggaagatgcaattgctttaataatcgactttcacccttagtagcagaaaaacgaccgtggccacagtaccacaaagtctctgatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatc

SEQ ID NO: 143293 - DNA, 861 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000488427
  CDS Start-End: 1-211
tgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaa

SEQ ID NO: 143294 - DNA, 585 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000480226
  CDS Start-End: 95-585
aatgaaaagtggtcaaacaacttaacatggtgccagttttcctaagcgtgcttgccactgattgtaatgcttttattgtttggcttcttgataaatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaag

SEQ ID NO: 143295 - DNA, 562 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000494395
  CDS Start-End: 1-325
agacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactg

SEQ ID NO: 143296 - DNA, 540 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000488494
  CDS Start-End: 84-540
agcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcagtaagtaagacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatgg

SEQ ID NO: 143297 - DNA, 788 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000474568
  CDS Start-End: 493-788
ccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagattttctataagaagcatatgctggttttataatctcagaaaagatacgttggagacagtctgtattagcgcttaccatgtagaaggcatactcttccttaggtagatgcaaagaaacctaaaacatactttgaacatagagcctgagaaattctgggattatggattagatgaatatggacttttcagttatttaacatactgaaagcaaagggaaagccttgaagattcttatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaa

SEQ ID NO: 143298 - DNA, 668 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000472147
  CDS Start-End: 627-668
tgttggctgggttggtctcaaactcctgacctcaggatgttggccttagcctgaagaaataaaaactgatgaagcgcattgttagcagagggatgacttgatcaggtttttgaaaacgaatgttcagcattgaggtaactgaggcatctggatatgctggtctgggcccctgggagccgcaggagataatggagatagagattctatgggctgagaccattgatgaatttacaaccaattttctggattggactgatcagttcagtttgctgtgtgtttgctcaaacagattttctataagaagcatatgctggttttataatctcagaaaagatacgttggagacagtctgtattagcgcttaccatgtagaaggcatactcttccttaggtagatgcaaagaaacctaaaacatactttgaacatagagcctgagaaattctgggattatggattagatgaatatggacttttcagttatttaacatactgaaagcaaagggaaagccttgaagattcttatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaa

SEQ ID NO: 143299 - DNA, 366 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000493758
  CDS Start-End: 274-366
atgaatttacaaccaattttctggattggactgatcagttcagtttgctgtgtgtttgctcaaacagattttctataagaagcatatgctggttttataatctcagaaaagatacgttggagacagtctgtattagcgcttaccatgtagaaggcatactcttccttagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagat

SEQ ID NO: 143300 - DNA, 562 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000534049
  CDS Start-End: 134-562
gagtttctgtgcacacactctcctgcctgctgccacgtaagacgtgccttttgcctgccgccatgtaatatgtgcctttgctcctccttcgccttctgccatgattgtgaggtctccccagccatgctgaactatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccatt

SEQ ID NO: 143301 - DNA, 546 bp, Homo sapiens
  Payload ID: 8310
  Gene Symbol: ITGB1
  Gene Name: integrin, beta 1 (fibronectin receptor, beta polypeptide, antigen CD29 includes MDF2, MSK12)
  ENST ID: ENST00000528877
  CDS Start-End: 234-546
agaaatcttaaagtagaagcgtcacaggacttgttcttccaaatgctgcatggcaaatattattaggaaatatacttaacatttatttatttttattctcaataaggagttacattcaaagtaactggaagtgacggatgagaaaaatatatctaggttggtgcacacagccatctggtcgaccttagacacgggaaggcaagcaccccctggttgaccttagacatggaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagaga

SEQ ID NO: 143302 - DNA, 2955 bp, Homo sapiens
  Payload ID: 8311
  Gene Symbol: ITGB2
  Gene Name: integrin, beta 2 (complement component 3 receptor 3 and 4 subunit)
  Uniprot ID: P05107
  ENST ID: ENST00000302347
  CDS Start-End: 234-2543
gggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatgg

SEQ ID NO: 143303 - DNA, 966 bp, Homo sapiens
  Payload ID: 8311
  Gene Symbol: ITGB2
  Gene Name: integrin, beta 2 (complement component 3 receptor 3 and 4 subunit)
  ENST ID: ENST00000320216
  CDS Start-End: 1-966
gggaggctggggaaggaccttgccactggggtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgag

SEQ ID NO: 143304 - DNA, 2913 bp, Homo sapiens
  Payload ID: 8311
  Gene Symbol: ITGB2
  Gene Name: integrin, beta 2 (complement component 3 receptor 3 and 4 subunit)
  Uniprot ID: P05107
  ENST ID: ENST00000355153
  CDS Start-End: 189-2498
atccagggtgaggaaggcagcccacacttttcttggagacacatccccaaagaagtcctcacgtggctccgtttgggcagaaaccatgaattgaacgggaaaagaaatatgtcaagtatcagaaagaagagtggcatgctttgacagcaagtggactccgagtccagggcagagcctcagttagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 143305 - DNA, 422 bp, Homo sapiens
  Payload ID: 8311
  Gene Symbol: ITGB2
  Gene Name: integrin, beta 2 (complement component 3 receptor 3 and 4 subunit)
  ENST ID: ENST00000397846
  CDS Start-End: 80-406
cgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgggagcggctttgggtcctccagcccacgccaccgcggcgagcagtccccggaggagaagccgggtggctcccgtctgtcctcggactgagcagggtggccaggccccaggtggaaactaccttggtcaggctgggttttttccctcccctttctggaggttttcagctcctctgaaataaacacctttcagtgaga

SEQ ID NO: 143306 - DNA, 3178 bp, Homo sapiens
  Payload ID: 8311
  Gene Symbol: ITGB2
  Gene Name: integrin, beta 2 (complement component 3 receptor 3 and 4 subunit)
  Uniprot ID: P05107
  ENST ID: ENST00000397850
  CDS Start-End: 454-2763
acaggcatccagggtgaggaaggctgcccacaggcatccagggtgaggaaggcagcccacacttttcttggagacacatccccaaagaagtcctcacgtggctccgtttgggcagaaaccatgaattgaacgggaaaagaaatatgtcaagtatcagaaagaagagtggcatgctttgacagcaagtggactccgagtccagggcagagcctcagttagggggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 143307 - DNA, 2769 bp, Homo sapiens
  Payload ID: 8311
  Gene Symbol: ITGB2
  Gene Name: integrin, beta 2 (complement component 3 receptor 3 and 4 subunit)
  Uniprot ID: P05107
  ENST ID: ENST00000397852
  CDS Start-End: 45-2354
gttgggcctgagaccgtcaccaagaccccttccctccacaggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 143308 - DNA, 2592 bp, Homo sapiens
  Payload ID: 8311
  Gene Symbol: ITGB2
  Gene Name: integrin, beta 2 (complement component 3 receptor 3 and 4 subunit)
  ENST ID: ENST00000397854
  CDS Start-End: 39-2177
ccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 143309 - DNA, 2813 bp, Homo sapiens
  Payload ID: 8311
  Gene Symbol: ITGB2
  Gene Name: integrin, beta 2 (complement component 3 receptor 3 and 4 subunit)
  Uniprot ID: P05107
  ENST ID: ENST00000397857
  CDS Start-End: 89-2398
gacagggccaagcccagctctcctccaagcacaggctctgctcacggaggacctggggcacactggggcagagtgcacacaccgggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 143310 - DNA, 2823 bp, Homo sapiens
  Payload ID: 8311
  Gene Symbol: ITGB2
  Gene Name: integrin, beta 2 (complement component 3 receptor 3 and 4 subunit)
  ENST ID: ENST00000523323
  CDS Start-End: 59-274
agcaaagcccccacgcccagccaggagcaccgccgaggactccagcacaccgagggacatgctgggcctgcgccccccactgctcgccctggtggggctgctctccctcgggtgcgggcggcccagagcacccactcaccagccggcctcgtccctcagtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatgg

SEQ ID NO: 143311 - DNA, 606 bp, Homo sapiens
  Payload ID: 8311
  Gene Symbol: ITGB2
  Gene Name: integrin, beta 2 (complement component 3 receptor 3 and 4 subunit)
  ENST ID: ENST00000522688
  CDS Start-End: 458-606
aagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcggtgagttctgtgttccacggaggggactccacgcgtgacattccaatcagggagaacagggcctgccctcactttcccatagacagaagttcccgggaggctggggaaggaccttgccactggggtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgacctt

SEQ ID NO: 143312 - DNA, 571 bp, Homo sapiens
  Payload ID: 8311
  Gene Symbol: ITGB2
  Gene Name: integrin, beta 2 (complement component 3 receptor 3 and 4 subunit)
  ENST ID: ENST00000517563
  CDS Start-End: 211-571
agaaagaagagtggcatgctttgacagcaagtggactccgagtccagggcagagcctcagttagggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggc

SEQ ID NO: 143313 - DNA, 568 bp, Homo sapiens
  Payload ID: 8311
  Gene Symbol: ITGB2
  Gene Name: integrin, beta 2 (complement component 3 receptor 3 and 4 subunit)
  ENST ID: ENST00000520389
  CDS Start-End: 111-392
acgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgggagcggctttgggtcctccagcccacgccaccgcggcgagcagtccccggaggagaagccgggtggctcccgtctgtcctcggactgagcagggtggccaggccccagaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacg

SEQ ID NO: 143314 - DNA, 680 bp, Homo sapiens
  Payload ID: 8311
  Gene Symbol: ITGB2
  Gene Name: integrin, beta 2 (complement component 3 receptor 3 and 4 subunit)
  ENST ID: ENST00000523663
  CDS Start-End: 182-680
atgcatgtatatgtgtggtgtgtgcatgcacgtggtgtgtacatgcagtcaggcacacatctgtatgcacgtacacgtgcatgtgtggtgtgtgtacacgtctgcatgtgtgtgtgtgcctgtgttgtgtgcctctgcaggggcccgctgcagctgtcctgggtgcctggctgagcaggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattg

SEQ ID NO: 143315 - DNA, 527 bp, Homo sapiens
  Payload ID: 8311
  Gene Symbol: ITGB2
  Gene Name: integrin, beta 2 (complement component 3 receptor 3 and 4 subunit)
  ENST ID: ENST00000517819
  CDS Start-End: 317-527
ctctcccaagtgtgaatctgatggaagcaggtccttctcgccgggacctcatgtgagaaatgacatgtcccacctgtctcaaggggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatga

SEQ ID NO: 143316 - DNA, 573 bp, Homo sapiens
  Payload ID: 8311
  Gene Symbol: ITGB2
  Gene Name: integrin, beta 2 (complement component 3 receptor 3 and 4 subunit)
  ENST ID: ENST00000522931
  CDS Start-End: 94-573
aagggcgactctgatgcaaggttctgagaggcctgtggggctgtggattcctaagcagcctcagctttgggttttgcaccttaggtcttggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatc

SEQ ID NO: 143317 - DNA, 556 bp, Homo sapiens
  Payload ID: 8311
  Gene Symbol: ITGB2
  Gene Name: integrin, beta 2 (complement component 3 receptor 3 and 4 subunit)
  ENST ID: ENST00000521995
  CDS Start-End: 410-556
agccacgttccagggcacctggctgggacctgccgcagcctctgcgcgcagcgggctccatcccccgggccacggattgggagactgaggcaggcgcgaagcccgccgcccagcctccgctagggagaccccggccacctccaggcagttttcctgaagcccggggccaggagaaggggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctg

SEQ ID NO: 143318 - DNA, 568 bp, Homo sapiens
  Payload ID: 8311
  Gene Symbol: ITGB2
  Gene Name: integrin, beta 2 (complement component 3 receptor 3 and 4 subunit)
  ENST ID: ENST00000524251
  CDS Start-End: 458-568
agacgtgacccagggcagactggtagcaaagcccccacgcccagccaggagcaccgccgaggactccagcacaccgagggacatgctgggcctgcgccccccactgctcgccctggtggggctgctctccctcgggtgcggtgagttctgtgttccacggaggggactccacgcgtgacattccaatcagggagaacagggcctgccctcactttcccatagacagaagttcccgggaggctggggaaggaccttgccactggggggcggcccagagcacccactcaccagccggcctcgtccctcagtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttac

SEQ ID NO: 143319 - DNA, 2200 bp, Homo sapiens
  Payload ID: 8311
  Gene Symbol: ITGB2
  Gene Name: integrin, beta 2 (complement component 3 receptor 3 and 4 subunit)
  ENST ID: ENST00000610622
  CDS Start-End: 53-1189
gcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatcgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttgg

SEQ ID NO: 143320 - DNA, 3995 bp, Homo sapiens
  Payload ID: 8312
  Gene Symbol: ITGB3
  Gene Name: integrin, beta 3 (platelet glycoprotein IIIa, antigen CD61)
  Uniprot ID: P05106
  ENST ID: ENST00000559488
  CDS Start-End: 17-2383
gcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgtgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgag

SEQ ID NO: 143321 - DNA, 1668 bp, Homo sapiens
  Payload ID: 8312
  Gene Symbol: ITGB3
  Gene Name: integrin, beta 3 (platelet glycoprotein IIIa, antigen CD61)
  ENST ID: ENST00000571680
  CDS Start-End: 10-1341
gcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgaggtgggctgggcagggcctttgtcctggagcatctgtgggcacccaaccccctttcttccttttgtagtgactaaaaatggcccccttccaccagaaaaaaaatatgggcaagaaaaatacgtttcctgaaagtcattctaagttagatgtaatggatccaccaatcttttcctctgaggcttctgttgcgtaagccatttctgttacgtgaacttcactctcaggaatttgaaaaacttacaatttggttacctttgtttgtgtatgcacagttgattgcaaaggaaaatatttctttaccttcagtccctcaccagtcgccagcctttccaaggtaattaatacctttcttttgtaaaacgacacaagaaagtaaaatctaaaatgtaaaaca

SEQ ID NO: 143322 - DNA, 408 bp, Homo sapiens
  Payload ID: 8312
  Gene Symbol: ITGB3
  Gene Name: integrin, beta 3 (platelet glycoprotein IIIa, antigen CD61)
  ENST ID: ENST00000573377
  CDS Start-End: 1-108
ctcaagtcttgtatgggactcaagattggagacacggtgaggtgggctgggcagggcctttgtcctggagcatctgtgggcacccaaccccctttcttccttttgtagtgactaaaaatggcccccttccaccagaaaaaaaatatgggcaagaaaaatacgtttcctgaaagtcattctaagttagatgtaatggatccaccaatcttttcctctgaggcttctgttgcgtaagccatttctgttacgtgaacttcactctcaggaatttgaaaaacttacaatttggttacctttgtttgtgtatgcacagttgattgcaaaggaaaatatttctttaccttcagtccctcaccagtcgccagcctttccaaggtgagcttcagcattgaggccaaggtgcgaggc

SEQ ID NO: 143323 - DNA, 5919 bp, Homo sapiens
  Payload ID: 8313
  Gene Symbol: ITGB4
  Gene Name: integrin, beta 4
  Uniprot ID: P16144
  ENST ID: ENST00000200181
  CDS Start-End: 188-5656
gcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 143324 - DNA, 5689 bp, Homo sapiens
  Payload ID: 8313
  Gene Symbol: ITGB4
  Gene Name: integrin, beta 4
  Uniprot ID: P16144
  ENST ID: ENST00000449880
  CDS Start-End: 9-5426
ggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 143325 - DNA, 5645 bp, Homo sapiens
  Payload ID: 8313
  Gene Symbol: ITGB4
  Gene Name: integrin, beta 4
  Uniprot ID: P16144
  ENST ID: ENST00000450894
  CDS Start-End: 127-5385
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactg

SEQ ID NO: 143326 - DNA, 688 bp, Homo sapiens
  Payload ID: 8313
  Gene Symbol: ITGB4
  Gene Name: integrin, beta 4
  ENST ID: ENST00000578318
  CDS Start-End: 1-191
aggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtgggtgagcactgagggctaggggatcccggctctcctgggacagggagctagcagagggagaagggcagaccccaagccaggtcatctaatgcctcctcctccacagatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 143327 - DNA, 5554 bp, Homo sapiens
  Payload ID: 8313
  Gene Symbol: ITGB4
  Gene Name: integrin, beta 4
  Uniprot ID: P16144
  ENST ID: ENST00000579662
  CDS Start-End: 247-5505
ccggcggcggcacccagctcctgccccgacaggtgcgcgccgcgcgaaggaatgcagccggtctgactcaccagcgcctccttcctacctgcgcgcccgccccataaagcgctgcccgcctcgtccccacccccccaacccccgcgcccgccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgact

SEQ ID NO: 143328 - DNA, 458 bp, Homo sapiens
  Payload ID: 8313
  Gene Symbol: ITGB4
  Gene Name: integrin, beta 4
  ENST ID: ENST00000582629
  CDS Start-End: 1-345
tccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 143329 - DNA, 603 bp, Homo sapiens
  Payload ID: 8313
  Gene Symbol: ITGB4
  Gene Name: integrin, beta 4
  ENST ID: ENST00000584939
  CDS Start-End: 1-603
gcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgg

SEQ ID NO: 143330 - DNA, 4372 bp, Homo sapiens
  Payload ID: 8314
  Gene Symbol: ITGB5
  Gene Name: integrin, beta 5
  Uniprot ID: P18084
  ENST ID: ENST00000296181
  CDS Start-End: 298-2697
gcggagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcggcccccggccctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaaccaccccttgttctgaggggctgaggctggaaatagattgtacagacaagcaagggttgagtggtggttcccacacgaagtcatctcttaatcatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaa

SEQ ID NO: 143331 - DNA, 1164 bp, Homo sapiens
  Payload ID: 8314
  Gene Symbol: ITGB5
  Gene Name: integrin, beta 5
  ENST ID: ENST00000465464
  CDS Start-End: 483-605
gggcgtctacgtcccatctcaggccgccggcagtgaggctttgggaggatgaggcggtaccggcacgacccccgtacctgctctccctctcgcagtctagcaaccgcctttggcccaagtaatctcggctcgcctaatacagcgtgccccgcccctttcccgtggcgacgggcggctaagcaacgggagcgggctctactcagtggtttcgagccccccacgccccaagtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccgagcagtggccgagggtaccagatggaggtttgaccagggatgctcagtgccttggaaatggattaacacagtgctgcatgtggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtac

SEQ ID NO: 143332 - DNA, 789 bp, Homo sapiens
  Payload ID: 8314
  Gene Symbol: ITGB5
  Gene Name: integrin, beta 5
  ENST ID: ENST00000496703
  CDS Start-End: 1-789
ttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccag

SEQ ID NO: 143333 - DNA, 576 bp, Homo sapiens
  Payload ID: 8314
  Gene Symbol: ITGB5
  Gene Name: integrin, beta 5
  ENST ID: ENST00000483168
  CDS Start-End: 340-576
gtgccccgcccctttcccgtggcgacgggcggctaagcaacgggagcgggctctactcagtggtttcgagccccccacgccccaagtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatc

SEQ ID NO: 143334 - DNA, 1202 bp, Homo sapiens
  Payload ID: 8314
  Gene Symbol: ITGB5
  Gene Name: integrin, beta 5
  ENST ID: ENST00000481591
  CDS Start-End: 1-1202
gaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatgcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggag

SEQ ID NO: 143335 - DNA, 548 bp, Homo sapiens
  Payload ID: 8314
  Gene Symbol: ITGB5
  Gene Name: integrin, beta 5
  ENST ID: ENST00000608107
  CDS Start-End: 372-548
aaagggagtgagtctgacattacacataccagcacacagcctgtggttttggatcctggagtacctgtctggtacctggtacccggcacactgtgagttcctggacatcaagggctggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggag

SEQ ID NO: 143336 - DNA, 825 bp, Homo sapiens
  Payload ID: 8314
  Gene Symbol: ITGB5
  Gene Name: integrin, beta 5
  ENST ID: ENST00000608657
  CDS Start-End: 408-825
aactttcattttattatttctttttatcgagacagagtctcaccctgtcgcccaggctggagtgcagtggcgagatctcgactcactacaacctctgcctcctgggatcaagcgattctcctgcctcagcctcccgaatagctgggattacaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgagg

SEQ ID NO: 143337 - DNA, 971 bp, Homo sapiens
  Payload ID: 8314
  Gene Symbol: ITGB5
  Gene Name: integrin, beta 5
  ENST ID: ENST00000488466
  CDS Start-End: 1-971
atccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaagagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccgggg

SEQ ID NO: 143338 - DNA, 4675 bp, Homo sapiens
  Payload ID: 8315
  Gene Symbol: ITGB6
  Gene Name: integrin, beta 6
  Uniprot ID: P18564
  ENST ID: ENST00000283249
  CDS Start-End: 239-2605
ttgaagttgcttttaaacacagcttttctgctttacctgtccaggtagcctctgttttcatttcagtcttaatgaaaactttctaacttatatctcaagtttcttttcaaagcagtgtaagtagtatttaaaatgttatacttcaagaaagaaagactttaacgatattcagcgttggtcttgtaacgctgaaggtaattcattttttaatcggtctgcacagcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattagggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattattgtattttgtgttgatataaataaacatggtaatttaaacaatgaacctta

SEQ ID NO: 143339 - DNA, 2501 bp, Homo sapiens
  Payload ID: 8315
  Gene Symbol: ITGB6
  Gene Name: integrin, beta 6
  Uniprot ID: P18564
  ENST ID: ENST00000409872
  CDS Start-End: 135-2501
atgttgaagttgcttttaaacacagcttttctgctttacctgtccaggtagcctctgttttcatttcagtcttaatgaaaactttctaacttatatctcaagtttcttttcaaagcagtcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctag

SEQ ID NO: 143340 - DNA, 4500 bp, Homo sapiens
  Payload ID: 8315
  Gene Symbol: ITGB6
  Gene Name: integrin, beta 6
  ENST ID: ENST00000409583
  CDS Start-End: 242-454
atgttgaagttgcttttaaacacagcttttctgctttacctgtccaggtagcctctgttttcatttcagtcttaatgaaaactttctaacttatatctcaagtttcttttcaaagcagtgtaagtagtatttaaaatgttatacttcaagaaagaaagactttaacgatattcagcgttggtcttgtaacgctgaaggtaattcattttttaatcggtctgcacagcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattagggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattattgtattttgtgttgatataaataaacatggtaatttaaacaatgaa

SEQ ID NO: 143341 - DNA, 2292 bp, Homo sapiens
  Payload ID: 8315
  Gene Symbol: ITGB6
  Gene Name: integrin, beta 6
  Uniprot ID: P18564
  ENST ID: ENST00000409967
  CDS Start-End: 196-2241
ggtagcctctgttttcatttcagtcttaatgaaaactttctaacttatatctcaagtttcttttcaaagcagtgtaagtagtatttaaaatgttatacttcaagaaagaaagactttaacgatattcagcgttggtcttgtaacgctgaaggtaattcattttttaatcggtctgcacagcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatg

SEQ ID NO: 143342 - DNA, 2576 bp, Homo sapiens
  Payload ID: 8315
  Gene Symbol: ITGB6
  Gene Name: integrin, beta 6
  ENST ID: ENST00000428609
  CDS Start-End: 236-2476
ctctgttttcatttcagtcttaatgaaaactttctaacttatatctcaagtttcttttcaaagcagtgtaagtagtatttaaaatgttatacttcaagaaagaaagactttaacgatattcagcgttggtcttgtaacgctgaaggtaattcattttttaatcggtctgcacagcaagaactgaaacgaatggggattgaactgctttgcctgttctttctatttctaggaaggaatgatcacgtacaagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaa

SEQ ID NO: 143343 - DNA, 4401 bp, Homo sapiens
  Payload ID: 8315
  Gene Symbol: ITGB6
  Gene Name: integrin, beta 6
  ENST ID: ENST00000620391
  CDS Start-End: 251-2332
aagtaaatcatgttgaagttgcttttaaacacagcttttctgctttacctgtccaggtagcctctgttttcatttcagtcttaatgaaaactttctaacttatatctcaagtttcttttcaaagcagtgtaagtagtatttaaaatgttatacttcaagaaagaaagactttaacgatattcagcgttggtcttgtaacgctgaaggtaattcattttttaatcggtctgcacagcaagaactgaaacgaatggggattgaactgctttgcctgttctttctatttctaggaaggaatgatcacgtacaaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatccccttttgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattagggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattattgtattttgtgttgatataaataaacatggtaatttaaacaatgaacctt

SEQ ID NO: 143344 - DNA, 2867 bp, Homo sapiens
  Payload ID: 8316
  Gene Symbol: ITGB7
  Gene Name: integrin, beta 7
  Uniprot ID: P26010
  ENST ID: ENST00000267082
  CDS Start-End: 233-2629
aaatcttccccaccctggggagtgtcacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaccaca

SEQ ID NO: 143345 - DNA, 2791 bp, Homo sapiens
  Payload ID: 8316
  Gene Symbol: ITGB7
  Gene Name: integrin, beta 7
  Uniprot ID: P26010
  ENST ID: ENST00000422257
  CDS Start-End: 162-2558
cacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcaga

SEQ ID NO: 143346 - DNA, 1841 bp, Homo sapiens
  Payload ID: 8316
  Gene Symbol: ITGB7
  Gene Name: integrin, beta 7
  ENST ID: ENST00000542497
  CDS Start-End: 84-1499
acttcctcctctgccgtctcccagatcagtacacaaaggctgctgctgccgccagaggaaggactgctctgcacgcacctggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctg

SEQ ID NO: 143347 - DNA, 576 bp, Homo sapiens
  Payload ID: 8316
  Gene Symbol: ITGB7
  Gene Name: integrin, beta 7
  ENST ID: ENST00000549086
  CDS Start-End: 311-576
agtacacaaaggctgctgctgccgccagaggaaggactgctctgcacgcacctctcagacttcttcctaatcggcaccttggtcacagactccactgtcctgggacactgaggcccagcagctcagttccgtcccctccttgtgactcccagtgggcagcagagggttctgcttgatttggaagatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcg

SEQ ID NO: 143348 - DNA, 607 bp, Homo sapiens
  Payload ID: 8316
  Gene Symbol: ITGB7
  Gene Name: integrin, beta 7
  ENST ID: ENST00000552972
  CDS Start-End: 132-607
acttcctcctctgccgtctcccagatcagtacacaaaggctgctgctgccgccagaggaaggactgctctgcacgcacctatgtggaaactaaagcccagagagaaagtctgacttgccccacagccaggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatgga

SEQ ID NO: 143349 - DNA, 2138 bp, Homo sapiens
  Payload ID: 8316
  Gene Symbol: ITGB7
  Gene Name: integrin, beta 7
  Uniprot ID: P26010
  ENST ID: ENST00000550743
  CDS Start-End: 1-1953
atggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgca

SEQ ID NO: 143350 - DNA, 513 bp, Homo sapiens
  Payload ID: 8316
  Gene Symbol: ITGB7
  Gene Name: integrin, beta 7
  ENST ID: ENST00000552935
  CDS Start-End: 233-513
cttttctttaattcccagtcactgaccctcttctcttatttagaatccaagattgtaaaagccgccaagtatgtcagactatttattcaacttctccactttgcagatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctgga

SEQ ID NO: 143351 - DNA, 729 bp, Homo sapiens
  Payload ID: 8316
  Gene Symbol: ITGB7
  Gene Name: integrin, beta 7
  ENST ID: ENST00000551319
  CDS Start-End: 1-353
gcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcagctcctaggattcggctcaaggctggcctcttaggtctagaaaggggacgaggaatcctgggatttttgcttataatctgcaacatctttctccaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcaga

SEQ ID NO: 143352 - DNA, 8751 bp, Homo sapiens
  Payload ID: 8317
  Gene Symbol: ITGB8
  Gene Name: integrin, beta 8
  Uniprot ID: P26012
  ENST ID: ENST00000222573
  CDS Start-End: 685-2994
cccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtgcttctcgcggagaccgcgggacccgccgtgccgagccgggagggccgcaggggccctgagatgccgagcggtgcccgggcccgcttacctgcaccgcttgctccgagccgcggggtccgcctgctaggcctgcggaaaacgtcctagcgacactcggcccgcgggccccgaggtgcgcccgggaggcgcgagcccgcgtccggaaggcagtcaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaataggggacactgtaaagtatcatcaaaacctgaatagcttcattgtgcacaagtgtggagttttgtatcctcttacctggtaaactgaagggattgtttggccatttcatttatcttatcattaattcacaagatagttagaaattctgcctcaagcaaagtaccacattttgaatgttttcttagattttgattgcaagtagatatcagcattttttaaatgaaaagctatattatcttctcccttcaaggcagcctaaggatgttctttcccagaatcactccaacccttcttgccagaattcataaaagtacaaaattggagaatagatgatatcttagaaataagctttttttttttttttttttttttttgagacggagtttcactcttgtcacccaggctgaagtgcaatggcgcaattagggttcactgcaacctctgcctcccgggttcaagcagttctcctgcctcagcctcctgagtagctgggattacaggcatccaccaccgtgcccagctaatttttgtatttttagtagagacggggttttgccatgttggacaggttgatctcaaactcctgacctcaggtgatctaccctcctcggcctcccagagtgttgggattacaggcatgagccaccatgccaggctgctaattctcctttttagtgagttagggaactgagcctcagaaaacttaaacgatttctcagaaaacactcaagtgataaagtggccacattggaaaggagtttttatcttctcattgtcaggccagtgttcattgcacaatatcatgctacctcttgaatctttaaaatattcaattggcaaatgtttttcaatgtgatttactcatgtcttaagtgtatgaggaaagttcaaagcaaaatagaaaggaataattcaaactgaattgtccataatcagcttccagtctttcatgctaatcagcttcttaagagactgaagtatggcatacctacaggggaattccttcgcaccatagcctgtatgaacagtgttccctggagttctccagtgctcagcttgagaccttgatacacgggccatgagccctgtcttccccaatggaaatttatttacacttaccttatccctatggacttagtctgattttattggctaggagtctaacagtcctgtgtggatatacagttttgcccatgacaacaaaggaatctatccgaaatatctttttttttataataaacttccaagatttgctgtcttccagcacttgagttaaagtactagatactgcattttgatgaagactaaccccatctcatattctaccctaaagagaactgaaaaacctataataagttgttctggagccaataaacacagcagctctgttagatgtcctctacagccaagcactttcaatgctaacttgaactgcatttccttcctcaaatgagagattgacataattcagtactgtgagtcacttgtataagaaacctttgatcactaaaaataatgtaaaaattgggtttagtagcctaatacacataacgttcttcttaaaaaggaaaatggatggatgcctgacaaccctccaaaagaaaaaagtgtaagatagccattaagatgatgacaatttttgaaatgaacattatgatatttatgaacaataaacaaatttccgtatggaatgaattatccaaaaagagtataacaaaatgaaatccttaaaaatccagagtttatattttttttataccctcacttgtttgcactaactttatagtggaccaaggctgttaccataggaagggacaaacttccttgtaggcaactcagtgttagacgatgattgtggttatgcttgcaaagtcttgtgcttatcttttttgtttttacttaaaaagctaatttttaaagattgtagggcttgtattttacttgaataattgatatcttcctgtgtaatgatttgtgagatgagaattaatatttgactagttagaattaattaaatggtaagggaacacagggtactcttaggttaaataatgtatgcaaatagagtctattttcaactaatatggccacaggagccttttgagattcattgatattaaacacaattaatgaaattttaaattgttaacagaattgagaacttgaacaacacttttagtactgcagcatttttgtgccctaaagtatgtaatgatttataaatgtgccatacatacactacaacataacatttgctttgttatgcattttatttctctggggacaccattgcactgcagtgcacacgtatttataaacatttgttatatttttggaaacttgctaatatttattaagtcatagacttttctggaggacttaaaaattcactaaaaatctgattatgtcttaaatgttcagtttatctttggtttattaaaataaaaaaaaaatctaagattaaacacagtagatatctctggaggcaattttccaaaactcaacattaaaatttgtggatgcatgagatgcaatccttcaaagaatgaatctgaaatatatttttaatatttacttaatatccactgaagatatctttatgcaagacaagagtcagccatcagacactgaaatatattatgatagattatgaagaattttctctgtagaattatattcttcctggaacctggtagagtagattagactcaaaggctttttcttccttttcttactcctgttttttccactcactcttcccaagagatttcctaaagcttcaagcttaataagcctaatagtgaaaaataactgaatttaatggtataatgaagttcttcatttccagacatctttaattgatcttaaagctcatttgagtctttgcccctgaacaaagacagacccattaaaatctaagaattctaaattttcacaactgtttgagcttcttttcattttgaaggatttggaatatatatgttttcataaaagtatcaagtgaaatatagttacatgggagctcaatcatgtgcagattgcattctgttatgttgactcaatatttaatttacaactatccttatttatattgacctcaagaactccattttatgcaatgcagaccactgagatatagctaacattctttcaaataattttccttttcttttataattcctctatagcaaatttttatgtataactgattatacatatccatatttatatttcattgattccaagacatcactttttcaatttaacatctctgaaattgtgacatttcttgcaactgttggcacttcagatgcagtgtttaaaattatgcttgaataaatattacactaatccaactttacctaaatgtttatgcatctaggcaaattttgttttcttataaagatttgagagcccatttatgacaaaatatgaaggcgaaatttaaggacaactgagtcacgcacaactcaacatggagcctaactgattatcagctcagatcccgcatatcttgagtttacaaaagctctttcaggtccccatttatactttacgtgagtgcgaatgatttcagcaaaccctaacttaactaacaagaatgggtaggtatgtctacgtttcattaacaaatttttattatttttattctattatatgagatccttttatattatcatctcacttttaaacaaaattaactggaaaaatattacatggaactgtcatagttaggttttgcagcatcttacatgtcttgtatcaatggcaggagaaaaatatgataaaaacaatcagtgctgtgaaaaacaactttcttctagagtcctcttactttttattcttctttatcatttgtgggtttttcccccttggctctgatcactttaacttcaagcttatgtaacgactgttataaaactgcatatttaaattatttgaattatatgaaataattgttcagctatctgggcagctgttaatgtaaacctgagagtaataacactactcttttatctacctggaatacttttctgcataaaatttatctttgtaagctaactctattaatcaggtttcttctagcctctgcaacctacttcagttagaattgtctaatactgctctattaatcaggtttctagcctctacaacctacttcagttaaaattgtctaatacagcaatatttaaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacatattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaatttaatatagaatatatttttaaattaaatatttgaatataaaatagctctaagaaagaagcaaattatcactgaacatatttcttattatttctggctttgaattatacgtaacttaaattgtcttaaatgatacagaatattggagaatatgatactttcacataatatactatgaacctgttcatataactctgattgactactaacttctgttttatgtatttattaaagagctgacactgtagtttgtggtgagatgtttatttttctaacagagcttataacagttaggacaaggcatttaattaatgcatcattctgtttagtagtaggtgttaatcaatatgaaattctctgttttaaaataaaaatgtaaaaatctaa

SEQ ID NO: 143353 - DNA, 3420 bp, Homo sapiens
  Payload ID: 8317
  Gene Symbol: ITGB8
  Gene Name: integrin, beta 8
  Uniprot ID: P26012
  ENST ID: ENST00000537992
  CDS Start-End: 1183-3087
ctgcccgggctgcagccgcgcctgcgggcagccgaggcgaggcgctccggtagcgtggggaggtttcctagcaactctctgccctgagtgcacccggctacccgcaggtctggagccccccggggggccagagcaggaccacccctctcccgcccatcgccggcctcgcctctctcgcatcctagccgtgtgcaccccagagcgcgccagcaactcgggctctggactgcgggacgcctgagccgcgcactgaggcgaaaaggacaagggcacgcagcccccgccccgcgaagccgggctccggcacctcgcggaacctcccctcctgcgctcgcagccgcaggccccactccccgccagggagggagcggcgatgcctcgctctgtgcctgcgggtgtcggcgggtgcttctagggcgctcccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtcccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccggggcccttggccgtcgaaggaggtcttgggctggcacgaagagctgcccggccagagcatcccggccagaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctatgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttccc

SEQ ID NO: 143354 - DNA, 2007 bp, Homo sapiens
  Payload ID: 8318
  Gene Symbol: ITGBL1
  Gene Name: integrin, beta-like 1 (with EGF-like repeat domains)
  Uniprot ID: O95965
  ENST ID: ENST00000376162
  CDS Start-End: 13-1218
aaactttgtctcatgaacttagttgcagtgatgggagcatttaataaaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgttt

SEQ ID NO: 143355 - DNA, 2494 bp, Homo sapiens
  Payload ID: 8318
  Gene Symbol: ITGBL1
  Gene Name: integrin, beta-like 1 (with EGF-like repeat domains)
  Uniprot ID: O95965
  ENST ID: ENST00000376180
  CDS Start-End: 220-1704
accagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgttta

SEQ ID NO: 143356 - DNA, 4808 bp, Homo sapiens
  Payload ID: 8318
  Gene Symbol: ITGBL1
  Gene Name: integrin, beta-like 1 (with EGF-like repeat domains)
  Uniprot ID: O95965
  ENST ID: ENST00000545560
  CDS Start-End: 373-1434
atcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagagcaattttgatgacgtattcgctgatgcacagacattggaattcattacattatctagccatcgtaatacaaatgacctttggatttctctatcacggcgcttatcctcctattaaggatcagaaagttaaactttacggaccacgtacgtccctgtctcatattcttctttgttggtttctgtttaatactttaaagctgtaaaaaaaatttaaaaaattccttctgagctcccaggccatacaaaagcaacttaagggtggatttggctggcagctgggcagtactttgtcagcctcagctccactggaactgcccttgattctctatagctcatcacaaaacctcaggtatgtcttatttttcttataatcctctgtatgttattatcctttttattaacaacaacaactacaacaaaagtgctgctctttttcatagtctcatgtaagaagagtgtcaaaaatgtcctcggcatttgttttctcagaaaaagaatttagatattggagaaattatcataccataaaaagttcaaaatgtgattcatctaaaattttggacaaagatgaaaatatagtcagctctgttctagtgttcatttagttagaaaccatagtaccggaactgtattatagtagaagttaatggtacctaaactctaaggaatgctttttctttgaaaacagaaatatttttacttatttctgtccactatgtttgtgtgtatgtgtgtgtttgtgtgtgtatgtgtggttttgatgccagcaatgcaaacaccaatatatctattaagaagtgattgaatttagattggaaaaaataaaatagttacatgtaaagacataaactctttccttcttaaatgtgattttcaactctatgatagaaactccctctaaaaaacaagcagggcaagaacaaacttacttgtaatgggtgagagaaaataagcaaatctcattggctcattcctgtttttaggaagttgcagtgggattaatgtcaattggaagggatgcagcaagtttagagaaggtgttggcactaacgctgcttgtttggcaaatcatcatcactgaggtattccacccagagactttttcaaaaaagtcaactaaagtgctaagtcataagaggagagccattatacccgttgtctttctgggctccttgagtttatctggattccaacagcacttggaaagtaccgccctccactacctcaaatgcaaacacaatctctgccagtagacattggaattagacttagtgaaaaccaggaaaaaaaaaaaaaactaaaatataactcagccttagtttgcagactcaactgtcaacactttgaaaccctactccatattcaagagagtcaacaggccctatgtcacattgtaggctaagaaacctcagctatgactactatttcactcaaagtaagaccatgtacatcctggattttgatatgcctgcattttggaaaaaaaaattgaggatttagcccagtcgctttcccttgatatagccttgttctgaattaaaatggaaaaaatatttcaattattttcatcttgttctcaactggatgttagtcaatgtggtctctttttgaatatgtatcaaatattaatgatccataatattagggagataattttaaatgaagtgatacgtgtctaacttacttaaagaataagtttttggtttttgcttttaaagacaaccaaatctgatattgttcatcctgataaaaataacaacttttagtgcttaaagcattaattaagcaagtggctaggtatgataaagaacttctgcttgctccccaagaggcaaactattagaagaactggagcgggagtcctttggacccatcgtggatctctttaagccactgctacccaaaaacattcaggacaagcaaacatttagagcaagaatctccaaattcttcaggatttgtaatgaaatgatgttcagttccattttgctctttacatagggtggagaattgtcatgtcttctctaatttttccaagtaaagtggtagcaaaatgttttaaaaagcaatcttatattagaaaacaaaaatgttgtcacttgaaataccaaaacaacatttctgagcgttgttgagggactggcaaagcaatcagctactataacaaatcagtagaaataaccctcccacaccagatatgcatgcagaaggaatggagtattatagagacttgatacaatggacatatgcacatggaggtacaaaacacacagtctaaatacaaatgaattccatcagatttactatacggaacatcagtagtgacagattgcacttcttacttaataacagcaaacttaatttctgaggggaaaaaaatggcgaagtcttatcccaaacaaatagcaagagaggtatcatcaaagagctaaaattttctttggcatggtaaagggggaaattgagtttaccaacttatttacatgacatttctctatattggtgagtaatgcaatgccattttgttacataaagttgtttgatgttttttaatatgccttcatataaatattttattcaatatgttgtatttgtgaatttaacaaatgatattaaacacaaactacaatgcagacagacaaactctttgtatgcaaattagcaatacataccaacagttcttgatacacaggtacctactacatgcagctcatcattgctgtcctcttcccatgctacaggtgagaccagacacaaagtaaatgacctaactcaattacaaataacaaggacccctctgcaatatgtctaaacatatattagaagaaagtatttgacatccttcatagggataaatgcccttatagacaccccatatataaaacacaacagagatacacatttacataaatctcagtcatttacaaaaataaatcttgtcttaatttaaaccaataaacagacttgcaggggaaaaagaaaccagcaagtagggctaattatcagtaacaaatagatgggggtgtttgctctgtgtgtgtgtgtgtgtgtgtgtgtgtgtgtgtgtatatgtgtgtgtttgtgtgaagtgaagtgttgctgctgtaagtagtgtccataagcccatttgactgtattacaagttagttaattactcatatagttggccacatattatgggatctatgttttctgaaaataattggttaatggaagttatctaatatattttaactgttcctgttaaaaacaataggcttcaagatgacataacaccaaatcaaaaatgaccaaaggaatcattttgtttgttagatttgtaatttagcatcattggcaataaatctactcaaacgtt

SEQ ID NO: 143357 - DNA, 1487 bp, Homo sapiens
  Payload ID: 8318
  Gene Symbol: ITGBL1
  Gene Name: integrin, beta-like 1 (with EGF-like repeat domains)
  ENST ID: ENST00000490242
  CDS Start-End: 1-625
ctgtgaaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagagcaattttgatgacgtattcgctgatgcacagacattggaattcattacattatctagccatcgtaatacaaatgacctttggatttctctatcacggcgcttatcctcctattaaggatcagaaagttaaactttacggaccacgtacgtccctgtctcatattcttctttgttggtttctgtttaatactttaaagctgtaaaaaaaatttaaaaaattccttctgagctcccaggccatacaaaagcaacttaagggtggatttggctggcagctgggcagtactttgtcagcctcagctccactggaactgcccttgattctctatagctcatcacaaaacctcaggtatgtcttatttttcttataatcctctgtatgttattatcctttttattaacaacaacaactacaacaaaagtgctgctctttttcatagtctcatgtaagaagagtgtcaaaaatgtcctcggcatttgttttctcagaaaaagaatttagatattggagaaattatcataccataaaaagttcaaaatgtgattcatctaaaattttggacaaagatgaaaatatagtcagctctgttctagtgttcatttagttagaaaccatagtaccggaactgtattatagtagaagttaatggtacctaaactctaaggaatgctttttctttgaaaacagaaatatttttacttatttctgtccactatgtttgtgtgtatgtgtgtgtttgtgtgtgtatgtgtggttttgatgccagcaatgcaaacaccaatatatctattaagaagtgattgaatttagattggaaaaaataaaatagttacatgtaaagacat

SEQ ID NO: 143358 - DNA, 2369 bp, Homo sapiens
  Payload ID: 8318
  Gene Symbol: ITGBL1
  Gene Name: integrin, beta-like 1 (with EGF-like repeat domains)
  ENST ID: ENST00000622834
  CDS Start-End: 379-1584
agctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcggcgtctgcatctgccacgtgactgagccgggcatgttcttcgggcccctgtgtgagtgccatgagtgggtgtgcgagacctacgacgggagcacctgtgcaggccatggtaagtgtgggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagtt

SEQ ID NO: 143359 - DNA, 2368 bp, Homo sapiens
  Payload ID: 8318
  Gene Symbol: ITGBL1
  Gene Name: integrin, beta-like 1 (with EGF-like repeat domains)
  ENST ID: ENST00000618057
  CDS Start-End: 242-1579
actctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgttt

SEQ ID NO: 143360 - DNA, 1546 bp, Homo sapiens
  Payload ID: 8319
  Gene Symbol: IBSP
  Gene Name: integrin-binding sialoprotein
  Uniprot ID: P21815
  ENST ID: ENST00000226284
  CDS Start-End: 68-1021
tctgtgccactcactgccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaataaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggaggagacaatggagaagaaggggaagaagaaagtgtcactggagccaatgcagaagacaccacagagaccggaaggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgccaatgaatacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctgggatgaattcatccattctggctttgcatccggctaccattttcgaagttcaactcaggaaggtgcaatataacaaatgtgcatattataatgaggaatggtactaccgttccagattttctgtaattgcttctgcaaagtaataggcttcttgtcccttttttttctggcatgttatggaatgatcattgtaaatcaggaccatttatcaagcagtacaccaactcataagatcaaatttcattgaatggtttgaggttgtagctctataaatagtagtttttaacatgcctgtagtattgctaactgcaaaaacatactctttgtacaagaagtgcttctaagaatttcattgacattaatgacactgtatacaataaatgtgtagtttcttaatcgcactacctatgcaacactgtgtattaggtttatcatcctcatgtatttttatgtgacctgtatgtatattctaatctacgagttttatcacaaataaaaatgcaatccttcaaa

SEQ ID NO: 143361 - DNA, 1802 bp, Homo sapiens
  Payload ID: 8320
  Gene Symbol: ILK
  Gene Name: integrin-linked kinase
  Uniprot ID: Q13418
  ENST ID: ENST00000299421
  CDS Start-End: 185-1543
aagagcgccacgggcggggcggggccggcggcgggctgcgggcgcggccggacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaa

SEQ ID NO: 143362 - DNA, 2074 bp, Homo sapiens
  Payload ID: 8320
  Gene Symbol: ILK
  Gene Name: integrin-linked kinase
  Uniprot ID: Q13418
  ENST ID: ENST00000396751
  CDS Start-End: 457-1815
agtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgttcgcggatagggtctagttgcctgctctcggacatccgttcagcagacactacctcttcgtcaccccctgcccaccctgacccgcctttacctcgcgtctagaggacacagccagggatcatcccgcagccccgaactccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaa

SEQ ID NO: 143363 - DNA, 1692 bp, Homo sapiens
  Payload ID: 8320
  Gene Symbol: ILK
  Gene Name: integrin-linked kinase
  Uniprot ID: Q13418
  ENST ID: ENST00000420936
  CDS Start-End: 112-1470
gcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggaggga

SEQ ID NO: 143364 - DNA, 851 bp, Homo sapiens
  Payload ID: 8320
  Gene Symbol: ILK
  Gene Name: integrin-linked kinase
  ENST ID: ENST00000526114
  CDS Start-End: 143-253
cgcggccggacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggtatcgtcttggatgctttgtgaagagcaggtggaaaggaggcaattgcctagttcatcgtagaagtaatgatgtcttggactagaattaggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagag

SEQ ID NO: 143365 - DNA, 1617 bp, Homo sapiens
  Payload ID: 8320
  Gene Symbol: ILK
  Gene Name: integrin-linked kinase
  Uniprot ID: Q13418
  ENST ID: ENST00000532063
  CDS Start-End: 398-1354
agggacggaggcccgcgctgcccaagagcgccacgggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacagg

SEQ ID NO: 143366 - DNA, 1559 bp, Homo sapiens
  Payload ID: 8320
  Gene Symbol: ILK
  Gene Name: integrin-linked kinase
  Uniprot ID: Q13418
  ENST ID: ENST00000528995
  CDS Start-End: 129-1304
agttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagagagcgggcagagaagatgggccagaatctcaaccgtattccatacaaggacacattctggaaggggaccacccgcactcggccccctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatg

SEQ ID NO: 143367 - DNA, 891 bp, Homo sapiens
  Payload ID: 8320
  Gene Symbol: ILK
  Gene Name: integrin-linked kinase
  ENST ID: ENST00000527121
  CDS Start-End: 88-198
acgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggtatcgtcttggatgctttgtgaagagcaggtggaaaggaggcaattgcctagttcatcgtagaagtaatgatgtcttggactagaattaggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaaga

SEQ ID NO: 143368 - DNA, 1801 bp, Homo sapiens
  Payload ID: 8320
  Gene Symbol: ILK
  Gene Name: integrin-linked kinase
  ENST ID: ENST00000537806
  CDS Start-End: 126-1577
gcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgaggtccatctccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatc

SEQ ID NO: 143369 - DNA, 1594 bp, Homo sapiens
  Payload ID: 8320
  Gene Symbol: ILK
  Gene Name: integrin-linked kinase
  ENST ID: ENST00000526711
  CDS Start-End: 139-261
aagagcgccacgggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacagg

SEQ ID NO: 143370 - DNA, 596 bp, Homo sapiens
  Payload ID: 8320
  Gene Symbol: ILK
  Gene Name: integrin-linked kinase
  ENST ID: ENST00000526318
  CDS Start-End: 1-336
cgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaac

SEQ ID NO: 143371 - DNA, 111 bp, Homo sapiens
  Payload ID: 8320
  Gene Symbol: ILK
  Gene Name: integrin-linked kinase
  ENST ID: ENST00000627400
  CDS Start-End: 1-111
atggacgacattttcactcagtgccgggagggcaacgcagtcgccgttcgcctgtggctggacaacacggagaacgacctcaaccagggtatcgtcttggatgctttgtga

SEQ ID NO: 143372 - DNA, 1490 bp, Homo sapiens
  Payload ID: 8321
  Gene Symbol: ILKAP
  Gene Name: integrin-linked kinase-associated serine/threonine phosphatase
  Uniprot ID: Q9H0C8
  ENST ID: ENST00000254654
  CDS Start-End: 177-1355
gggccacgccgcgcgccgattggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctctttttttttcctag

SEQ ID NO: 143373 - DNA, 793 bp, Homo sapiens
  Payload ID: 8321
  Gene Symbol: ILKAP
  Gene Name: integrin-linked kinase-associated serine/threonine phosphatase
  ENST ID: ENST00000457149
  CDS Start-End: 156-793
ggtggcgtccgggactctccctgcaggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttcctcttcggtgatctttggtctgaagggctatgtggctgagcggaagggtgagagggaggagatgcaggatgcccacgtcatcctgaacgacatcaccgaggagtgtaggcccccatcgtccctcattactcgggtttcatattttgctgtttttgatggacatggaggaattcgagcctcaaaatttgctgcacagaatttgcatcaaaacttaatcagaaaatttcctaaaggagatgtaatcagtgtagagaaaaccgtgaagagatgccttttggacactttcaagcatactgatgaagagttccttaaacaagcttccagccagaagcctgcctggaaaga

SEQ ID NO: 143374 - DNA, 1024 bp, Homo sapiens
  Payload ID: 8321
  Gene Symbol: ILKAP
  Gene Name: integrin-linked kinase-associated serine/threonine phosphatase
  ENST ID: ENST00000450411
  CDS Start-End: 1-612
gagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggtgagaaatctcacacgggggtggtggttgtcccaattgtgtcttagttttcagagaagtagaagttctgagaccccatttcctcccattgtgggacagcccttgtgccctttttcagtgtgaactctgcctactgactcactggtcagtttgtcctgccagccctgatggagaccagagcagctcttcttcctggcagtcatgtctcaggaaagtgacagggtgcggggtcactccattcactcattccctttctcatctggtaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctcttttttt

SEQ ID NO: 143375 - DNA, 1335 bp, Homo sapiens
  Payload ID: 8321
  Gene Symbol: ILKAP
  Gene Name: integrin-linked kinase-associated serine/threonine phosphatase
  ENST ID: ENST00000612675
  CDS Start-End: 131-619
ggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggttctcttgccacatcaatatcccagatggtaaagactgaagggaaaggagcaaagagaaaaacctccgaggaagagaagaatggcagtgaagagcttgtggaaaagaaagtttgtaaagcctcttcggtgatctttggtctgaagggctatgtggctgagcggaagggtgagagggaggagatgcaggatgcccacgtcatcctgaacgacatcaccgaggagtgtaggcccccatcgtccctcatgagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctctttttttttcct

SEQ ID NO: 143376 - DNA, 1088 bp, Homo sapiens
  Payload ID: 8321
  Gene Symbol: ILKAP
  Gene Name: integrin-linked kinase-associated serine/threonine phosphatase
  ENST ID: ENST00000622223
  CDS Start-End: 131-955
ggtgactgacggcgccggccgcccctgcccgtcgcccgcccgctgctgccgcccgcccggggtgtggagcccggccgctgctcgcgggctgagtgtctgtcgctgctgccgcctccacccagcctccgccatggacctcttcggggacctgccggagcccgagcgctcgccgcgcccggctgccgggaaagaagctcagaaaggacccctgctctttgatgacctccctccggccagcagtactgactcaggatcagggggacctttgctttttgatgatctcccacccgctagcagtggcgattcaggagatgtaatcagtgtagagaaaaccgtgaagagatgccttttggacactttcaagcatactgatgaagagttccttaaacaagcttccagccagaagcctgcctggaaagatgggtccactgccacgtgtgttctggctgtagacaacattctttatattgccaacctcggagatagtcgggcaatcttgtgtcgttataatgaggagagtcaaaaacatgcagccttaagcctcagcaaagagcataatccaactcagtatgaagagcggatgaggatacagaaggctggaggaaacgtcagggatgggcgtgttttgggcgtgctagaggtgtcacgctccattggggacgggcagtacaagcgctgcggtgtcacctctgtgcccgacatcagacgctgccagctgacccccaatgacaggttcattttgttggcctgtgatgggctcttcaaggtctttaccccagaagaagccgtgaacttcatcttgtcctgtctcgaggatgaaaagatccagacccgggaagggaagtccgcagccgacgcccgctacgaagcagcctgcaacaggctggccaacaaggcggtgcagcggggctcggccgacaacgtcactgtgatggtggtgcggatagggcactgaggggtggcgcgcggccaggagcacgcatggtattgacttaaaaggttcattttgtgtgtgtgcacattgtgtgttttgtgtactcctgtgggactcccatggttgtaaataaaggtttctctttttttttcct

SEQ ID NO: 143377 - DNA, 1183 bp, Homo sapiens
  Payload ID: 8322
  Gene Symbol: ITLN1
  Gene Name: intelectin 1 (galactofuranose binding)
  Uniprot ID: Q8WWA0
  ENST ID: ENST00000326245
  CDS Start-End: 117-1058
aggagcgtttttggagaaagctgcactctgttgagctccagggcgcagtggagggagggagtgaaggagctctctgtacccaaggaaagtgcagctgagactcagacaagattacaatgaaccaactcagcttcctgctgtttctcatagcgaccaccagaggatggagtacagatgaggctaatacttacttcaaggaatggacctgttcttcgtctccatctctgcccagaagctgcaaggaaatcaaagacgaatgtcctagtgcatttgatggcctgtattttctccgcactgagaatggtgttatctaccagaccttctgtgacatgacctctgggggtggcggctggaccctggtggccagcgtgcacgagaatgacatgcgtgggaagtgcacggtgggcgatcgctggtccagtcagcagggcagcaaagcagtctacccagagggggacggcaactgggccaactacaacacctttggatctgcagaggcggccacgagcgatgactacaagaaccctggctactacgacatccaggccaaggacctgggcatctggcacgtgcccaataagtcccccatgcagcactggagaaacagctccctgctgaggtaccgcacggacactggcttcctccagacactgggacataatctgtttggcatctaccagaaatatccagtgaaatatggagaaggaaagtgttggactgacaacggcccggtgatccctgtggtctatgattttggcgacgcccagaaaacagcatcttattactcaccctatggccagcgggaattcactgcgggatttgttcagttcagggtatttaataacgagagagcagccaacgccttgtgtgctggaatgagggtcaccggatgtaacactgagcaccactgcattggtggaggaggatactttccagaggccagtccccagcagtgtggagatttttctggttttgattggagtggatatggaactcatgttggttacagcagcagccgtgagataactgaggcagctgtgcttctattctatcgttgagagttttgtgggagggaacccagacctctcctcccaaccatgagatcccaaggatggagaacaacttacccagtagctagaatgttaatggcagaagagaaaacaataaatcatattgactcaag

SEQ ID NO: 143378 - DNA, 1151 bp, Homo sapiens
  Payload ID: 8323
  Gene Symbol: ITLN2
  Gene Name: intelectin 2
  Uniprot ID: Q8WWU7
  ENST ID: ENST00000368029
  CDS Start-End: 59-1036
gcaggggagctccgagtgtccacaggaagggaactatcagctcctggcatctgtaaggatgctgtccatgctgaggacaatgaccagactctgcttcctgttattcttctctgtggccaccagtgggtgcagtgcagcagcagcctcttctcttgagatgctctcgagggaattcgaaacctgtgccttctccttttcttccctgcctagaagctgcaaagaaatcaaggaacgctgccatagtgcaggtgatggcctgtattttctccgcaccaagaatggtgttgtctaccagaccttctgtgacatgacttctgggggtggcggctggaccctggtggccagcgtgcacgagaatgacatgcgtgggaagtgcacggtgggtgatcgctggtccagtcagcagggcaacaaagcagactacccagagggggatggcaactgggccaactacaacacctttggatctgcagaggcggccacgagcgatgactacaagaaccctggctactacgacatccaggccaaggacctgggcatctggcatgtgcccaacaagtcccccatgcagcattggagaaacagcgccctgctgaggtaccgcaccaacactggcttcctccagagactgggacataatctgtttggcatctaccagaaatacccagtgaaatacagatcagggaaatgttggaatgacaatggcccagccatacctgtggtctatgactttggtgatgctaagaagactgcatcttattactcaccgtatggtcaacgggaatttgttgcaggattcgttcagttccgggtgtttaataacgagagagcagccaacgccctttgtgctgggataaaagttactggctgtaacactgagcatcactgcatcggtggaggagggttcttcccacagggcaaaccccgtcagtgtggggacttctccgcctttgactgggatggatatggaactcacgttaagagcagctgcagtcgggagataacggaggcggctgtactcttgttctatagatgagacagagctctgcggtgtcagggcgagaacccatcttccaaccccggctatttggagacggaaaaactggaattctaacaaggaggagaggagactaaatcacatcaatttgcaa

SEQ ID NO: 143379 - DNA, 6689 bp, Homo sapiens
  Payload ID: 8324
  Gene Symbol: IPCEF1
  Gene Name: interaction protein for cytohesin exchange factors 1
  Uniprot ID: Q8WWN9
  ENST ID: ENST00000265198
  CDS Start-End: 157-1470
tttaagtagaatcctcaagcttggcctcagagtactatgaggcttctgaatccaggaataagactgctcttggatttactctctttgtattgcatgtcaaaggcaacagaactggaccaagaaaattcataactttttgcttttgtttctactaagatgacatcatacatggctattgatggcagtgctcttgttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttcttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgtttaa

SEQ ID NO: 143380 - DNA, 1658 bp, Homo sapiens
  Payload ID: 8324
  Gene Symbol: IPCEF1
  Gene Name: interaction protein for cytohesin exchange factors 1
  Uniprot ID: Q8WWN9
  ENST ID: ENST00000367220
  CDS Start-End: 126-1442
gtactatgaggcttctgaatccaggaataagactgctcttggatttactctctttgtattgcatgtcaaaggcaacagaactggaccaagaaaattcataactttttgcttttgtttctactaagatgacatcatacatggctattgatggcagtgctcttcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagt

SEQ ID NO: 143381 - DNA, 3267 bp, Homo sapiens
  Payload ID: 8324
  Gene Symbol: IPCEF1
  Gene Name: interaction protein for cytohesin exchange factors 1
  Uniprot ID: Q8WWN9
  ENST ID: ENST00000422970
  CDS Start-End: 197-1513
acatgtagtcttctcactttcttcttgccatgagactgagagagtgctccttgggacggagtttcagagtcatcaactgggctcatgagaaccacaagaaacctacgaaggcactgggacagagcctggctgctggtcaaaggcaacagaactggaccaagaaaattcataactttttgcttttgtttctactaagatgacatcatacatggctattgatggcagtgctcttcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaatggaaggaaccacctgaattatatctgcaaacaaaatggaaatagttgttgaatagttccccaagctttactaagaagccttaatactctgtaaacaaacaaacaaacaaaaaacaaccttagca

SEQ ID NO: 143382 - DNA, 558 bp, Homo sapiens
  Payload ID: 8324
  Gene Symbol: IPCEF1
  Gene Name: interaction protein for cytohesin exchange factors 1
  ENST ID: ENST00000519405
  CDS Start-End: 174-558
agaaaaactggcagtgagtcgggaagtagctgtgtattgaggtgggcattaacccttcaacatctattgcataactacggctgttattgttgagaggagctatgttactgcactgatatgcccgccagccttacaattttaattattttcaacttattcttggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaac

SEQ ID NO: 143383 - DNA, 568 bp, Homo sapiens
  Payload ID: 8324
  Gene Symbol: IPCEF1
  Gene Name: interaction protein for cytohesin exchange factors 1
  ENST ID: ENST00000519190
  CDS Start-End: 244-568
tctccattttgtgtacgttgagtgtggcttttctccggggtgccttccttgggatcagatttctgtctgtcttaatgctaataagaggaggtggacggcagattaatttttggttattgttgaatcgattttaagaaatgacgacatgttgttcatttggattaatccctcgtggtatgtcaaaagagcttagaaaaactggcagtgagtcgggaagtagctgtgtattgaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggat

SEQ ID NO: 143384 - DNA, 1621 bp, Homo sapiens
  Payload ID: 8324
  Gene Symbol: IPCEF1
  Gene Name: interaction protein for cytohesin exchange factors 1
  ENST ID: ENST00000519344
  CDS Start-End: 246-1475
agctcaatgtatattgattctaattagcacattttgtgcctcagctagtagctccccgttaagctctgcctggagagtttttttttagattccatcctgctcataaacactgccacctcctccctccttctctctttacaaatgttacaacacaatcagaaatttcctcttttctttccttcctgcattttcagcaggttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaag

SEQ ID NO: 143385 - DNA, 485 bp, Homo sapiens
  Payload ID: 8324
  Gene Symbol: IPCEF1
  Gene Name: interaction protein for cytohesin exchange factors 1
  ENST ID: ENST00000520261
  CDS Start-End: 251-485
gactgagtttccagagctgaggctgctttaagtagaatcctcaagcttggcctcagagtactatgaggcttctgaatccaggaataagactgctcttggatttactctctttgtattgcatagtcatcaactgggctcatgagaaccacaagaaacctacgaaggcactgggacagagcctggctgctggtcaaaggcaacagaactggaccaagaaaattcataactttttgcttttgtttctactaagatgacatcatacatggctattgatggcagtgctcttgttcccttgcgtcagaagcccaggaggaaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagca

SEQ ID NO: 143386 - DNA, 580 bp, Homo sapiens
  Payload ID: 8324
  Gene Symbol: IPCEF1
  Gene Name: interaction protein for cytohesin exchange factors 1
  ENST ID: ENST00000517438
  CDS Start-End: 108-580
aaaagttgcctttcactctgtcacataaatcaggataatactttacctaccaaatcagggtaatacattatctacctcttcatgtaatcattgcaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatc

SEQ ID NO: 143387 - DNA, 7927 bp, Homo sapiens
  Payload ID: 8325
  Gene Symbol: ICE1
  Gene Name: interactor of little elongation complex ELL subunit 1
  Uniprot ID: Q9Y2F5
  ENST ID: ENST00000296564
  CDS Start-End: 223-7023
ggggccgcgccgggtagcgtttctttttagtgcctgaggcagctctggctcggagagccttttgctagccccacggggacctctgtgcacggatggacccgcccggacctggcgggaagcggcctggcaggcggcggccccggcggcatcagcagagacaggacggggccgacgccgcgggcccctgaggcgtgcgtgcccaccgggcccggcggcggcaccatgatgccgggcgagacccattcggcggcgcccgggacggcggcggacctgtcgcgatgtcagggctgcgcctctctgcagcagaatttgaatgaatatgttgaagcattaattaccttgaaacaaaaaattatcaatacagataatttgttaacagaatatcagaagaaatgtgatgagctgcagtttgcaagaagagagaatagtaatctgcatcaccaagtggaagagatgcttcaaaaaatttctcctctacagaaatgtcaggaagaactgggatctttaaaagcagagctagaagagaaaaagagttctttaaagttgtatcaggatactcatcaggaatatgctcgtgtaaaggaagaatgcttgaagagtgatgctcagaagaagaaactagaagctaaggtgaagaagctgcaagaggctgctgtcaagcaaactcaggacttcaagcaactgagaaatgaaaagaaaatacttgaaaaggaatttaagaagacacaggaaaggcttgacgaattttctaaacagaaaaatgaaaaggagttgagacatattggaacacaaatttcaagtgattcatatggaagcatagataaaagaaaagtgaaactgcttctgaaggaactctggctctgtgtaaacacaacacacagactacctggtgaaggcagcaggtgtgtcccagaaaaacctgccaaagcaatcaccagctccagagtgcctggggaagatggtacgctacctccaacacagggcagccctctcaggacctcaaatgtgcagacatgcctcacaaaactgtccatggagataaaggaggactttttatgtcaaaatgtggaaaaacagagctccagtggaacaaattgtagttctgaccatgtttttaatgagaatggaaatcttgaggttttagtacaaagtcatcgtgacggtggtagtactgaatttgttgatcatgatcatttttttgatgaagatcttcaagctgcaattgacttcttcaaacttccccctcctcttctgtcaccagtgccctcgccccctccgatgtcatcacctcacccgggttccttaccgtcttcatttgcacctgaaacctactttggagaatacacagattccagcgataatgactcagtccagcttagaaattctgctgagtgtgtttcagaagatgatacaactgaatcacagaattattttggctcattgagaaaaaataaaggaagtggcacatgggaggaaaagcccaaatcacatgaagctatccaagctctgaatacatgggaagtaaataaagtgacaacttctggactcgagactttcacagcaacactgagagaatcttctgccacacactccttagttggtgaaaaacactggaccacagcatctcgatccatgagtgatagaaaaagagacattttacatgagacaaaaacacaaatggaggttagggagatggataagtcagtacaaactgagaagaccattcataaactcactcgaggtctatgcattgagagattgtctgccagccctgcacaagagaaggaagctgcccctgggaagtctgagttgtgttcttctccccttggcaaaaggccattaaatgaactcatggaatctgaaggaaaaaccgtattgtctaaaatgatgggatcgcccaaatcagagtttactaagtggacacgaattaatgaaatcacttctgaaccagaccgtatcacagtttctggccattttcacagactatctagagaattggaaaaggaaaaagaagatactcaagggttcactttaggagaatcacctgaatcagaagatgatgactcaggtgatggaatggatgtagcagggcttgacattgaaaccagtttttcttcctcttctaccttggtagcattgtctgttggcagtaatccccagtcttcttctgggttagactgtggtaatgatacagatattactactaaagtattctctactgaaccgcatcattcagaacataaattgcaaactaaaactttaaacacattacatctgcagtctgagccaccggagtgttctataggaggaaacaacttggagaatagcttgtgtgccttgagccctgaattgggagcatctaattttaatgatcagaagagcagtgggatagaatatacaaaagtagtaaaaggcttgaccaaaatacattcacttcctcggtcagtatttatgaaagctacaaaagatgggcaatgtgaaagtcaagatccaagaattgagctcacactaaataagccagatttcacatcattaataggttctcaggctgccttgatcaagagtggtttgggttttgttaaaagtacttcatggcaccatagtgatttattaaggaaaggtggcgaagaaagtctgagagccaaatcagaacatgaacagaagactagccatcagttacaaaaggcaatgccattcctacaaaatagaggaccaacacccaagcctgatcttcttagagaaaataacaatcctgtagaattcaagaccactgcatcggtgttgcctaatcaagtatcagttatcacaaaacagacaagacctgaaaaggttcagagtgccaaattggaacacttgaggccacatagggttgagcctaccttagtaacagaaaatagtggcaacaaaaccggtatgtcaactgtagcaaaatgtgatggggaaagagatgatacaacacaaaacatcacggaggtggctgctgtgaaaagcatttcaccagaagtttctgcctctaggagaaaattagattttaattctccaggtggttcttcaccagtagaaaattctgattgttccacaaatagcagattatctttctctcctgaaaatatcctcatccaaaaccaagacattgtgagagaagctgcagtgcagggagatgggcagaagcaaaggcagcctcaggccacagatctggactccagtgggacacatggcagtgagatgcttccagccacagaagtgactgtgtcaggagggttttctgttgaagaaaccagctgtggagacacagggagatctggtggtgaggccctggctgttgcaaatgattctaccagcacaccacaaaatgctaatggactttggaaattgaaatctacaactcccggtggtgctttgcctgagtgttttggcaccacagacactactttttcttcagcattttgcagaaaacatggagagacacaggatacctcccaaagtagcctgcctggtaccttacattgttacacaggcattcgagaggggggagacgacactgaggtagagagtgaggcatttagctgcagtgaggggagcgaacagcaagatgctcctgatgactcacagaaaaatttaggagacacagatgctgctgtagccgaggtgagaccttccttagaggtaggttatttgacgtcagctctgcaagattttaacataagtactttttctgagctggatagactttccacatcagaggttgtgatgtttcttgagagctgtcagttaggggattatagttcaggggactctgtttctgaatgttctagtaaaggaaccctaagtaaagaaatgaacaaagaattaaaggcaagtgaaataggagaaaaatacagaaagcaaccctgtgaggaagaaacacttggaacctgtgaagagtggattgaatcagaggaagatgattattcgttaaaaaatacaagtcagctcactcagtgttctttggaaactctgtctgaggttctgaccaagattaggcaagaacttcaaacaaattctgaagattgcaatggtaaagatactggcagtttattgctcttaaatgtaaataacaacatgaccactgagaatttaaaagagaaaagtccatttcgggaaacgactggctcctcatcacatgcttcagaaccaaccccacaagcagctgccttggacactgagggcagctctcccatcagcggtatgcctcagaatgaaaaccctcagagcagaccagaggcccgttcagatgcaggcaggcaaaccgatggtggggaagaagacctgccagaacctgtggagccatcagccttgtgctctgactctgtgatggagccatccatagagcaaagttctaactgcgaggccgaaacaacatttcagtgtcagatagcaacagtgacctcagaagttataaacgtacttataaataaggatcagaatctagtcattgaaaagggggacaactggacaatcatcagtggtgtagctgtcttgccacatgtggaccaggtcacactgtgtgacattcctggagacatccctatttctcaggatcaaggagagctggaagctggttgcatcccagtgacttctgctgagaagtccccagaggccagtcacactggccctgcatttcaggaggctccatgtggcaataatctttcatgtccccaagaggatgtttcaagcagtggtcagagcaccaactttgataagagtcgtttgcgaaatagacccgttaagcctagtatatggattagttctcaaatctatgatcaaaacttcgagactcagattgttgcgtctgatcacacatattataactcaaaactagagccatctggcaaaaataagaatcgatcaaagatttcaaacaaagatcagtcaaacaaaccagtaaaaacttcagcgtcgagcagagttgaaactcatcagagtgaagttgctcagtcattttcaggggaaaaagctaatacaaaaactcaaagaagccaaactcagaccattttagcaaatgctgatacatccactcctacagattgttctcctgacacactgagtaaaatacggcaagaggtggggcctcctttgccgcctctgcttgctcctctgatagctacacctccaaggacttcacagccactgtctccactgatatcgagttctagtccttcctcaccagcctctcctgttggccaggtttctcccttccgtgaaaccccagtgcctcctgccatgtctccatggccagaggaccccagacgtgcctctcctccagatccttctccatctccatctgcagcttcagccagtgagagggtagtgccgtctcctctgcagttctgtgcggccacgccgaagcacgcacttcctgtgcctggccgactcccaccctgtgcatctggccacgctgctgtgggagggcctcaggagaattctgtgaaaatccttgacaccatgtatccagagttatctgccagggcccggaccctcaacatcctcaaagggaatattcaactcacacgaggtccgcctgctgactgtaagaatttaccgggacctgccagtgctatgataggattcaaaacgatcacttcagcagcaactgcttttgtcaaaactgggagcagctctggtggtgactgtaaccaagacaagtcaagagatttggggactcagcaggattcaagcgggaaaagaacactgtcaacgtctacactgagaagtgctaaaagactgcgcctggacactgggtccccagaaccagaaaccaggggagtcactgcagaaggaatccacaaaaacctcccagggaacctccctccagctgaagttgcaacaacaaatgaggaaagaagttgttctagtccagccgtcagtgcagtttcacagttgcctttaagcccaaaagaaactgtggagtcccatgataaagccatagctaatgccctgaagaaaattgcagagttttcttttgatctgttacctgtcattcgtagtcatgtgtatgtgggaaatatctccaaaaagcccgtaatgagagatcaagagaaggaagttgtttatgaatttagcacaacaaaaaagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaagaatgccccggtagatgttggcttcatggtttctaagctgcttttgaccatacagttatgtccaaaaacagaatttcaacctagtgaaaaatttggtgaagacctaagtgataacacttgggaatacatatttgccattgatctgctctgctgccatcagaaatggatctggacgcatgataacatcataagtaaggagctgtggcctgtgatggataaatggataaaatacagaaaaggacatgcaaacattgcgtatactcctgatattattatagcctcaatactgaggctgattggtcgtttaggccaattgggtttgaaagaaggatttccatctgctgtgaaaaatattagttcggttattggtatgtttatacagcatgctcacgatgaagatataccatggggtatacagttagcagccgtgtatgctctttgtgacttgagtcccagcaatccagcagaaatttccaagatcctggaagcttggcggagagaggcctccaaaagcgttccgtctgcgattgtcagctgcctagaggaagtcagtgccctgagcacagaggagcttggctgacctgggatgccactgaggcttgagaagtgccttgacacattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtctcacattggatgatattccactttgggaattttagtatttgtatatagaaaatgggtttaataactcaccatggttttgatttgtcttatattcgttatttcttaaaactcttgtatgtgtttttataataaaaaataaaagtaagccatggatattactgttctga

SEQ ID NO: 143388 - DNA, 613 bp, Homo sapiens
  Payload ID: 8325
  Gene Symbol: ICE1
  Gene Name: interactor of little elongation complex ELL subunit 1
  ENST ID: ENST00000512608
  CDS Start-End: 177-613
agatgtcttgagaactggctttgagaaagaatttgaatgaatatgttgaagcattaattaccttgaaacaaaaaattatcaatacagataatttgttaacagaatatcagaagaaatgtgatgagctgcagtttgcaagaagagagaatagtaatctgcatcaccaagtggaagagatgcttcaaaaaatttctcctctacagaaatgtcaggaagaactgggatctttaaaagcagagctagaagagaaaaagagttctttaaagttgtatcaggatactcatcaggaatatgctcgtgtaaaggaagaatgcttgaagagtgatgctcagaagaagaaactagaagctaaggtgaagaagctgcaagaggctgctgtcaagcaaactcaggacttcaagcaactgagaaatgaaaagaaaatacttgaaaaggaatttaagaagacacaggaaaggcttgacgaattttctaaacagaaaaatgaaaaggagttgagacatattggaacacaaatttcaagtgattcatatggaagcatagataaaagaaaagtgaaactgcttctgaaggaactctggctctgtgtaaacacaacacacagactacctgg

SEQ ID NO: 143389 - DNA, 7209 bp, Homo sapiens
  Payload ID: 8326
  Gene Symbol: ICE2
  Gene Name: interactor of little elongation complex ELL subunit 2
  Uniprot ID: Q659A1
  ENST ID: ENST00000261520
  CDS Start-End: 236-3184
gacgtcatcacgcagggccgagtcggcgcggccacatcctttaaatatggtcttttttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaatcaaatctttcatgaagttccattaaaatttatgatgtccaaaaacacatctgttccagtctctgcagtctttatggacaaacctgaagagtttatatctgaaatggacatgtcctgtgaagtcaacgagtgccgaaaaattgagagtcttgaaaacttgtatttggattttgatgatgatgtcacagaacttgaaacttttggagtaaccaccaccaaagtatcaaaatcaccaagtccagcaagtacttccacagtacctaacatgacagatgctcctacagcccccaaagcaggaactacaactgtggcaccaagtgcaccagacatttctgctaattctagaagtttatctcagattctgatggaacaattgcaaaaggagaaacagctggtcactggtatggatggtggccctgaggaatgcaaaaataaagatgatcagggatttgaatcatgtgaaaaggtatcaaattctgacaagcctttgatacaagatagtgacttgaaaacatctgatgccttacagttagaaaattctcaggaaattgaaacttctaataaaaatgatatgactatagatatattacatgctgatggtgaaagacctaatgttctagaaaacctagacaactcaaaggaaaagactgttggatcagaagcagcaaaaactgaagatacagttctctgcagcagtgatacagatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggccgaaatctggatggccttctgcatttcagaagccaaaaggacgattgccatatgaacttcaggactatgttgaagatacatcggaatacctagctcctcaggaaggaaattttgtttataagttatttagcctgcaagacctgttgttactcgtacgctgcagtgtccagaggatagagacaagaccacgttctaaaaaacggaagaaaatcagaagacaatttccagtttatgtactaccaaaagtagagtatcaagcttgttatggagttgaagctctgactgaaagtgaactttgtcgcttatggactgaaagtttattgcattccaacagctcattttatgttgggcatatcgatgcatttacttcaaaactttttctactggaagaaattacctcagaagaattaaaagaaaagctttcagcactcaagatttccaatttatttaacatcctccaacacattctaaagaaactaagtagcttgcaggagggttcctacttgttatctcatgcagcagaagattcttcactcctgatttataaggcctctgatggaaaagttactaggacagcatacaatttgtataaaacacattgcggccttcctggtgtaccttccagtctctcagttccctgggtcccattagatcccagcctgttattaccatatcatatccatcatggaagaataccttgtacttttccaccgaaatcactggataccacaacacaacaaaagattggtggaacgagaatgcctacacgcagccacaggaatccagtttccatggaaaccaaaagcagttgcttgcctgctcagcaagttgaaactgaaggagtggctccacataaaagaaaaataacttgaggactgtaccatggaaaactaaatttaaaaaaacagttataacagtgtttaatttagataagtttgagggaaaataatcagtaggcaagaggaacatttttcctgtagtagctagagtgccttgaaaaaatgtgttggctatgtgaaggaatatttcaactaaaatggaatggtatgcttttcacccttgaagtttgaggaggatcttgatatgttttaacattatcatggcagggaaatatataaagaagaaaaatatttttacattaaaccttttctaaaaattgtaaatagaaaaataatttggttttttatcaagaacaacacttatcgttatgtattgtgttagttatattgccagtctgttgcgactgactcaaaaagttaaatgttgccactgctgaagatgattatgagcatcgcaaactttgtttctgacccattttgacagtttttatatactcctttaaaatgatgaatgttacaggttaataaagttaatacctttaaaaacttggtgaaattccattacagaagccaaaaataaaaactccctgcctctgaaaagtcagattactgacttcttgtttggcaaccatcagtttgtttaataaaagaaaaaatttggtggtataacatgtttgatgacagatgcctctatctctagattcaagctgagtgttgaaatacactgctgaaagcaaagagataggtatgttttccagaaaaaaagtcagtgtcattgctccagatgacaaggttaatgtggtaaagcataagcttttttttttttttgagatggagtctcgctctgttgcccaggctggagtgcagtggcatgatctcagctcaccacaacatccacctcctggattaaagcgattctcctgcctcatcctcccgagtagctgggactacaggcacctaccaccaggcttggctaatttttttttgtatttttagtagagacagggtgttaccatgttggccgggctggtctcaaactcctgaccttgtgatccgcctgccttggcctcccaaagtgctgggattacaggggtaagccaccgtgcctggccagcataagctatttttatcctcatctatactgattgatttaaattttccgggcctgcagatgaatttggaaaagggcataatcaactgatgttgctgtagcaaatttggacttaagaaactacagacagggccgggcgtggtggctcacacctgtaattccagcacttcgcaaggccgaggcgggagaatcacttgagtccaggggttggagaccagtctgggcaacacagacctcatctctacaaataaaaaagttagccgggtgtggtggggtgtgcctgtagtcccagctactcaaaaggctgaggcagaagaattgcttgagcccaagaagtcaaggctacagtgagttgtgatcgcaccacagaactcagcttgagtatcagagtgtgaccctgtctcaaagaaaaaaaaaaacaggacaggcttgtttaatctttagaacccttacactaaaattttcagaaattatgtatgtcatttgtaaaatataagttttgtaatcctagataattgcttcacattgaaattttttagctattctgtgtaaagaatagctattcttttggcctaatttctgagaaattagaccgaaaaatctcctcaagtattgtaacagttgaaaatacttatattcaactaccaagttttgtttcattttgattttttgttataaaacatttttaagttatttgagaagtaattattagtaaaattgtatcttgataaatcatttcctcatcctgccattcccttttataaaacactgagtttttttattccttaagtcacatatcccagaaatgttttggttgtgaatcatttgccagcgagccaagggagaggcagggattcccttgaaatgtactcttacacttttttattttatttttaatgtacatttgtgtgcaccagaatggaatgtgctctttttaaagagctggacagtggttgcttcagacttctgaataccagaaagacttgccttttaatttttaaatattactttttacatcataaaatgtgttatcttatccatgtatttgaataacatcatatataaaggtagttttttgcttgtgcttagtgaagcctccttttttaacatacatttgatatgctttatgttctttttcttgatttttagtactgagaatttataagccaagaagtaactgacaatatgtttagcaggatgtaatcccagctacttgggaagctgaggtgggaggatcgcttgagtctaggagtttgaggctgcagtgagctatgatggtgccactgcactccatcctgggtgagagatcaagaccctatctcaaaaaatgagcaagttttttttttttttttaaatcagacttagggctagcaaggatgtgatcaccctggcccatttatacctcagcagtgaaggtgtaatttatacacacctctttgaaaacagtttaattcagtaagtgagtgcaactatgtgccatgcactccaaagtaggtccccacagttattctctcatagccttgttttttcagatctcaccatatttatttgtttctttgattttcttttcttatagattacaagctctgcaaggacaggggcatatttgttttgttcaccattaagtaataaacacctaatacagtgcctgtcatgtagttgcttagcagatattagttagatgcatgaatgtgtaggtatcaaagattttttttttcaggagatcacattctagtggaagacactatactgctttatgtgataagtgctttgataaagtaagcaagtcatctaaccagatcttggtagttaaggttttctgagatagaacttgagctgagtcttttaaaaatagtaggatttataagggaaaattaaaggtcttccacaaagaaactaagtgaaactaagcagcctatgaaaaggtgaaagttggagagattataggctatgaacatgggagatgagagagaaaactgcaggatagggacagaaacactgtgctaagacatttgaactttgtcctgtgcaatgtgggaaccagtagtgaaggttaattaactgacatgatcagatatgtatttgaaaagggctcttgttggcattagtctagagaatgcgatggagctgggaagcgaaagaagaaatgttgggagcctgtgttgtagtaactgaaaaatggcaatggcccagaattaaagcagcaagaataggagtgggctcaagtgatgtataaggaaaaaaaaaaaaatgacaactcagttttgttgttggtaaggagagtaaagtatggcttctgggtttctcatttgagatactgagtaaatgatggtgttaacccattgagaaaatagtgtggttagagtgggaagaaagttaatttaaaatgttcatttttttttttagtcatttctacttttggattctaggtttgtgtgctatattggttataaccaatttgctgaataataaattatcccaaaacttagctacttaaaacaacaaacattatctcacagtttctgtaagtcaaaagtccaggtctctcatgaagttgcagtcaggctcttggctagggctgcagtcatctgaaggattagtaagtcgctaagcccacacttaagctccacccttgaagggagaagtttggaaagaatttgtgaacatatttttaaatcacatatgctatgaacaggtttaggggagggagaggaaagaaaactttaacttttcattagcatactgcatctgtagttcctaatgggcatgttgtaaagatgttaagacgttttctatgcattataggtatatagtagtattttgttttgttctgtttttttgtttggtatgtagtagtttttaatcaaaccttaacgtatttgatattaagatttattgagtttcttgttgagatgtagaaataaaggggatccatttcatttatcca

SEQ ID NO: 143390 - DNA, 568 bp, Homo sapiens
  Payload ID: 8326
  Gene Symbol: ICE2
  Gene Name: interactor of little elongation complex ELL subunit 2
  ENST ID: ENST00000560520
  CDS Start-End: 287-568
cacatcctttaaatatggtcttttttgggcgcgcgcgacaatgtgaggagtggggtggagcgtgtgtggtgtgtggctgcggcctgggcaagagccgccgcggaccatgaggtcactttatcagtctgcctggggtcacaggagaagtactgaacatgagagatcaagcctgatttgtagtcctgatgatgtctctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttat

SEQ ID NO: 143391 - DNA, 564 bp, Homo sapiens
  Payload ID: 8326
  Gene Symbol: ICE2
  Gene Name: interactor of little elongation complex ELL subunit 2
  ENST ID: ENST00000561446
  CDS Start-End: 104-289
atcctttaaatatggtcttttttgggcgcgcgcgacaatgtgaggagtggggtggagcgtgtgtggtgtgtggctgcggcctgggcaagagccgccgcggaccatgagggatatttcccccaaaaatggccttaagacatttttctctcgagaaaattataaagatcattccatggctccaagtttaaaagaactacgtgttttatccaacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactctt

SEQ ID NO: 143392 - DNA, 1470 bp, Homo sapiens
  Payload ID: 8326
  Gene Symbol: ICE2
  Gene Name: interactor of little elongation complex ELL subunit 2
  ENST ID: ENST00000558512
  CDS Start-End: 455-1470
aggggcgggaggagggaacatggcggccgggccaggaccctttgctcctggctctgcgcggctcctacccctgctttgcttgcccttttacctgcttttctggaaccttgtttcccctctctttgcgtcccctttccctcagccgtttcttttgccttcctcgactattcccccccagctccacactgggtcgaagtgtgagaggtagattaagtgggagccggtcgggcccgttcggtgtcgagagaccgactcctaaatttgattaggttctcgcaggtcactttatcagtctgcctggggtcacaggagaagtactgaacatgagagatcaagcctgatttgtagtcctgatgatgtctctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaa

SEQ ID NO: 143393 - DNA, 559 bp, Homo sapiens
  Payload ID: 8326
  Gene Symbol: ICE2
  Gene Name: interactor of little elongation complex ELL subunit 2
  ENST ID: ENST00000560072
  CDS Start-End: 125-559
aaatatggtcttttttgggcgcgcgcgacaatctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaa

SEQ ID NO: 143394 - DNA, 555 bp, Homo sapiens
  Payload ID: 8326
  Gene Symbol: ICE2
  Gene Name: interactor of little elongation complex ELL subunit 2
  Uniprot ID: Q659A1
  ENST ID: ENST00000560668
  CDS Start-End: 154-375
agggccgagtcggcgcggccacatcctttaaatatggtcttttttgggcgcgcgcgacaatctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaa

SEQ ID NO: 143395 - DNA, 7060 bp, Homo sapiens
  Payload ID: 8326
  Gene Symbol: ICE2
  Gene Name: interactor of little elongation complex ELL subunit 2
  Uniprot ID: Q659A1
  ENST ID: ENST00000558181
  CDS Start-End: 251-472
ccactatgtcgctgagacgtcatcacgcagggccgagtcggcgcggccacatcctttaaatatggtcttttttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaatcaaatctttcatgaagttccattaaaatttatgatgtccaaaaacacatctgttccagtctctgcagtctttatggacaaacctgaagagtttatatctgaaatggacatgtcctgtgaagtcaacgagtgccgaaaaattgagagtcttgaaaacttgtatttggattttgatgatgatgtcacagaacttgaaacttttggagtaaccaccaccaaagtatcaaaatcaccaagtccagcaagtacttccacagtacctaacatgacagatgctcctacagcccccaaagcaggaactacaactgtggcaccaagtgcaccagacatttctgctaattctagaagtttatctcagattctgatggaacaattgcaaaaggagaaacagctggtcactggtatggatggtggccctgaggaatgcaaaaataaagatgatcagggatttgaatcatgtgaaaaggtatcaaattctgacaagcctttgatacaagatagtgacttgaaaacatctgatgccttacagttagaaaattctcaggaaattgaaacttctaataaaaatgatatgactatagatatattacatgctgatggtgaaagacctaatgttctagaaaacctagacaactcaaaggaaaagactgttggatcagaagcagcaaaaactgaagatacagttctctgcagcagtgatacagatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggccgaaatctggatggccttctgcatttcagaagccaaaaggacgattgccatatgaacttcaggactatgttgaagatacatcggaatacctagctcctcaggaaggaaattttgtttataagttatttagcctgcaagacctgttgttactcgtacgctgcagtgtccagaggatagagacaagaccacgttctaaaaaacggaagaaaatcagaagacaatttccagtttatgtactaccaaaagtagagtatcaagcttgttatggagttgaagctctgactgaaagtgaactttgtcgcttatggactgaaagtttattgcattccaacagctcattttatgttgggcatatcgatgcatttacttcaaaactttttctactggaagaaattacctcagaagaattaaaagaaaagctttcagcactcaagatttccaatttatttaacatcctccaacacattctaaagaaactaagtagcttgcaggagggttcctacttgttatctcatgcagcagaagattcttcactcctgatttataaggcctctgatggaaaagttactaggacagcatacaatttgtataaaacacattgcggccttcctggtgtaccttccagtctctcagttccctgggtcccattagatcccagcctgttattaccatatcatatccatcatggaagaataccttgtacttttccaccgaaatcactggataccacaacacaacaaaagattggtggaacgagaatgcctacacgcagccacaggaatccagtttccatggaaaccaaaagcagttgcttgcctgctcagcaagttgaaactgaaggagtggctccacataaaagaaaaataacttgaggactgtaccatggaaaactaaatttaaaaaaacagttataacagtgtttaatttagataagtttgagggaaaataatcagtaggcaagaggaacatttttcctgtagtagctagagtgccttgaaaaaatgtgttggctatgtgaaggaatatttcaactaaaatggaatggtatgcttttcacccttgaagtttgaggaggatcttgatatgttttaacattatcatggcagggaaatatataaagaagaaaaatatttttacattaaaccttttctaaaaattgtaaatagaaaaataatttggttttttatcaagaacaacacttatcgttatgtattgtgttagttatattgccagtctgttgcgactgactcaaaaagttaaatgttgccactgctgaagatgattatgagcatcgcaaactttgtttctgacccattttgacagtttttatatactcctttaaaatgatgaatgttacaggttaataaagttaatacctttaaaaacttggtgaaattccattacagaagccaaaaataaaaactccctgcctctgaaaagtcagattactgacttcttgtttggcaaccatcagtttgtttaataaaagaaaaaatttggtggtataacatgtttgatgacagatgcctctatctctagattcaagctgagtgttgaaatacactgctgaaagcaaagagataggtatgttttccagaaaaaaagtcagtgtcattgctccagatgacaaggttaatgtggtaaagcataagcttttttttttttttgagatggagtctcgctctgttgcccaggctggagtgcagtggcatgatctcagctcaccacaacatccacctcctggattaaagcgattctcctgcctcatcctcccgagtagctgggactacaggcacctaccaccaggcttggctaatttttttttgtatttttagtagagacagggtgttaccatgttggccgggctggtctcaaactcctgaccttgtgatccgcctgccttggcctcccaaagtgctgggattacaggggtaagccaccgtgcctggccagcataagctatttttatcctcatctatactgattgatttaaattttccgggcctgcagatgaatttggaaaagggcataatcaactgatgttgctgtagcaaatttggacttaagaaactacagacagggccgggcgtggtggctcacacctgtaattccagcacttcgcaaggccgaggcgggagaatcacttgagtccaggggttggagaccagtctgggcaacacagacctcatctctacaaataaaaaagttagccgggtgtggtggggtgtgcctgtagtcccagctactcaaaaggctgaggcagaagaattgcttgagcccaagaagtcaaggctacagtgagttgtgatcgcaccacagaactcagcttgagtatcagagtgtgaccctgtctcaaagaaaaaaaaaaacaggacaggcttgtttaatctttagaacccttacactaaaattttcagaaattatgtatgtcatttgtaaaatataagttttgtaatcctagataattgcttcacattgaaattttttagctattctgtgtaaagaatagctattcttttggcctaatttctgagaaattagaccgaaaaatctcctcaagtattgtaacagttgaaaatacttatattcaactaccaagttttgtttcattttgattttttgttataaaacatttttaagttatttgagaagtaattattagtaaaattgtatcttgataaatcatttcctcatcctgccattcccttttataaaacactgagtttttttattccttaagtcacatatcccagaaatgttttggttgtgaatcatttgccagcgagccaagggagaggcagggattcccttgaaatgtactcttacacttttttattttatttttaatgtacatttgtgtgcaccagaatggaatgtgctctttttaaagagctggacagtggttgcttcagacttctgaataccagaaagacttgccttttaatttttaaatattactttttacatcataaaatgtgttatcttatccatgtatttgaataacatcatatataaaggtagttttttgcttgtgcttagtgaagcctccttttttaacatacatttgatatgctttatgttctttttcttgatttttagtactgagaatttataagccaagaagtaactgacaatatgtttagcaggatgtaatcccagctacttgggaagctgaggtgggaggatcgcttgagtctaggagtttgaggctgcagtgagctatgatggtgccactgcactccatcctgggtgagagatcaagaccctatctcaaaaaatgagcaagttttttttttttttttaaatcagacttagggctagcaaggatgtgatcaccctggcccatttatacctcagcagtgaaggtgtaatttatacacacctctttgaaaacagtttaattcagtaagtgagtgcaactatgtgccatgcactccaaagtaggtccccacagttattctctcatagccttgttttttcagatctcaccatatttatttgtttctttgattttcttttcttatagattacaagctctgcaaggacaggggcatatttgttttgttcaccattaagtaataaacacctaatacagtgcctgtcatgtagttgcttagcagatattagttagatgcatgaatgtgtaggtatcaaagattttttttttcaggagatcacattctagtggaagacactatactgctttatgtgataagtgctttgataaagtaagcaagtcatctaaccagatcttggtagttaaggttttctgagatagaacttgagctgagtcttttaaaaatagtaggatttataagggaaaattaaaggtcttccacaaagaaactaagtgaaactaagcagcctatgaaaaggtgaaagttggagagattataggctatgaacatgggagatgagagagaaaactgcaggatagggacagaaacactgtgctaagacatttgaactttgtcctgtgcaatgtgggaaccagtagtgaaggttaattaactgacatgatcagatatgtatttgaaaagggctcttgttggcattagtctagagaatgcgatggagctgggaagcgaaagaagaaatgttgggagcctgtgttgtagtaactgaaaaatggcaatggcccagaattaaagcagcaagaataggagtgggctcaagtgatgtataaggaaaaaaaaaaaaatgacaactcagttttgttgttggtaaggagagtaaagtatggcttctgggtttctcatttgagatactgagtaaatgatggtgttaacccattgagaaaatagtgtggttagagtgggaagaaagttaatttaaaatgttcatttttttttttagtcatttctacttttggattctaggtttgtgtgctatattggttataaccaatttgctgaataataaattatcccaaaacttagctacttaaaacaacaaacattatctcacagtttctgtaagtcaaaagtccaggtctctcatgaagttgcagtcaggctcttggctagggctgcagtcatctgaaggattagtaagtcgctaagcccacacttaagctccacccttgaagggagaagtttggaaagaatttgtgaacatatttttaaatcacatatgctatgaacaggtttaggggagggagaggaaagaaaactttaacttttcattagcatactgcatctgtagttcctaatgggcatgttgtaaagatgttaagacgttttctatgcattataggtatatagtagtattttgttttgttctgtttttttgtttggtatgtagtagtttttaatcaaaccttaacgtatttgatattaagatttattgagtttcttgttgagatgtagaaataaaggggatccatttcattta

SEQ ID NO: 143396 - DNA, 584 bp, Homo sapiens
  Payload ID: 8326
  Gene Symbol: ICE2
  Gene Name: interactor of little elongation complex ELL subunit 2
  ENST ID: ENST00000560406
  CDS Start-End: 287-584
aaatatggtcttttttgggcgcgcgcgacaatgtgaggagtggggtggagcgtgtgtggtgtgtggctgcggcctgggcaagagccgccgcggaccatgaggttctcgcaggtcactttatcagtctgcctggggtcacaggagaagtactgaacatgagagatcaagcctgatttgtagtcctgatgatgtctctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtt

SEQ ID NO: 143397 - DNA, 571 bp, Homo sapiens
  Payload ID: 8326
  Gene Symbol: ICE2
  Gene Name: interactor of little elongation complex ELL subunit 2
  ENST ID: ENST00000560895
  CDS Start-End: 201-356
atcctttaaatatggtcttttttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacg

SEQ ID NO: 143398 - DNA, 3796 bp, Homo sapiens
  Payload ID: 8326
  Gene Symbol: ICE2
  Gene Name: interactor of little elongation complex ELL subunit 2
  ENST ID: ENST00000561114
  CDS Start-End: 164-1315
atgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaatcaaatctttcatgaagttccattaaaatttatgatgtccaaaaacacatctgttccagtctctgcagtctttatggacaaacctgaagagtttatatctgaaatggacgtatgtaatgctttttttttcccctaaggggaatgtacttgtttatccttttgaagcataaagttttattgcaaatccctaaacctagtagttaaaaatacaggctttagattcaaactgaaattgaatttcgagtctagctggactttaggcaactaacttaacctccctcagcctaagttttctcctttcatacatgaaaggaagtagtacctacttgacaaggttattatgagggttaagtttgatattttatgttaaaggctgagcacgtttttagttatgtatgtagtgaaaactccttgatggtggtggttaatatgaggttttgtttaattggtctcattcatattcaagagttttatttttttgagatggaacctcaccctgccacccaggctggagtgcagtggtgcgatctctgctcactgcaacctccgcctcccgggttcaagtgatgctcctgcctcagactcccgagtagctgagattacaggtgtgcaccaccatacccagctaattttttgtagttttagtagagatgagatttcgccatgttggcctggctggtctcaaacttctgacttcaggtgatccacccatctcagccacccaaagtgctgggattacaggcgtcagccactgcacctgacccatatctaagagtttttaagtgtgaaaaggaacaggtgagcttaatttgattgttacagaaagtattttgccagattgttaatcttcagtatacttagtagctatgtgacctcgggcagattacataatatctctgtgtctagtttgcttatctgtaaaatgggcatcatgatattacctaactcataggattgtttaggtttaaatgaatttgtacatataaagcatttagagtaacacttggcactctgtaaatattagcttttattattctgtattttaaaatattttttccattatttttaaatacattgtttatagagaacttgattcattcattccataagtttttattaagcagatactattctatgcagggaggaagcagcagtgaataaaaacaaaacctgttttccctcagaccttaaataagtggcagagggcccagataacagtaaaaaagcaggtagtggtaaatgctatggagaaaaatagagtacgttaaggggaaatagagagatgggtggggaaggggtcattttatattcacgattaagaaggtttttctgaggataggaaatgtggacagagacttgagtaaaatgagggagcaaacaaaattttaaaatataaaaatgtttttcttgtacttaagagctcatacaattttaaggatattggccttttggtttttatatttgtttatgtttttctctttgccatttgccttttaatatttttatgatacatatgtcataaagcatttttaacttatgttttcttcttacacattttacttttaaaaatctgcctaaaacttatattgaggtgaatgtcaggcagtaacaagaagaaacatgaggtaggttaaaagggatgaaaattgacagtggcttctttcagtaatggtagaccaggtaatttggaccctccttttattgatgacatctaaaaaagctggacaaatattaaaatgtctttcttagaagtatcaaaaagctaacaagatagtgaggaattgtagggctgagatactgaagaaaacaggattcccagaaggtaagcctattatacttagggtcattttttccttggattatatgtgccagttctgaagaggcaactaagaaaatgaactgtgcttttggcagcatcataggactagggggataaaaggaaaacttcagttttccaccaagggcctggaccccaaaggggctgcacctcaggagtcagggtgaaccagaagtaaatgagctttctctgaaatgacagcctgagttttcaggccctgaacttggagtaaaatgctttttctggattgtgcaggtaaaagtaagtaaaaatgagaggatgataatgctttttttgcctcaaattattatacttcttaatgtctattagtctaatttatgttgctaagtgttctggaattattttgatttctgtggtccaacaatttggaatgtttttaaattttgaagtgcttgagtttattgtttgtttacatttttcttaatgatatctaattttatttccttctgaacatagaataagactttatcagattctgctttggtctatattgagattttctttgtatattaatttatagttcattttttgaaatgccctttggattcttgggaagggaaaaagtgtatctttgtagtctgtttatatatgtattttcaatctttcatatatattctcatcgtttattattattcatactttctggattcctttttattttttacttagagacagtatctcattgacttagtataattgtgtctctgtcaaatttttcttttatttttcagtttgtacaataaaaatttatgaccacta

SEQ ID NO: 143399 - DNA, 2911 bp, Homo sapiens
  Payload ID: 8327
  Gene Symbol: ITIH1
  Gene Name: inter-alpha-trypsin inhibitor heavy chain 1
  Uniprot ID: P19827
  ENST ID: ENST00000273283
  CDS Start-End: 25-2760
acagggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtcca

SEQ ID NO: 143400 - DNA, 1122 bp, Homo sapiens
  Payload ID: 8327
  Gene Symbol: ITIH1
  Gene Name: inter-alpha-trypsin inhibitor heavy chain 1
  ENST ID: ENST00000405128
  CDS Start-End: 140-973
gtgtcccgggagccaatcaagggcatgtgatgttgagtggacatccctgcttggtggcctcaggccagccccaccagtgaggaaagagtcatcagagggatcagcagctccagggaaggcctggctgccccgcttctaaatgccactccccctcccatcagcgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtc

SEQ ID NO: 143401 - DNA, 1517 bp, Homo sapiens
  Payload ID: 8327
  Gene Symbol: ITIH1
  Gene Name: inter-alpha-trypsin inhibitor heavy chain 1
  ENST ID: ENST00000428133
  CDS Start-End: 1-1395
tccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagagggtataggctgcagggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctca

SEQ ID NO: 143402 - DNA, 978 bp, Homo sapiens
  Payload ID: 8327
  Gene Symbol: ITIH1
  Gene Name: inter-alpha-trypsin inhibitor heavy chain 1
  ENST ID: ENST00000480409
  CDS Start-End: 22-663
gggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgaggtagatcacaggtcccggggcaggggtcctgcccctctctccgtcaccatggctcccaacactggttgagcacccaccatgtgtcaccacccaggcctgagaacacagggatggggactaacccctcagggtgagctctgatgtgctcttcttgggcagggaactccctgaattctctaacttcctctttatctctgagcttcggtttgctcatctgctagacggggggtttctgtgagtcccaggaccgccacagggatcacgagaagtactgaatgtccagattgatgtggacatcttcgagccccaggggatcagcaagctggatgcccaggcctctttcctgccgaaggaactggcagcccaaactatcaagaagtcctt

SEQ ID NO: 143403 - DNA, 414 bp, Homo sapiens
  Payload ID: 8327
  Gene Symbol: ITIH1
  Gene Name: inter-alpha-trypsin inhibitor heavy chain 1
  ENST ID: ENST00000484844
  CDS Start-End: 1-223
gatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggactccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttc

SEQ ID NO: 143404 - DNA, 2493 bp, Homo sapiens
  Payload ID: 8327
  Gene Symbol: ITIH1
  Gene Name: inter-alpha-trypsin inhibitor heavy chain 1
  Uniprot ID: P19827
  ENST ID: ENST00000537050
  CDS Start-End: 465-2336
gaattattgctggcacctaagtggtggctgagttgagggatgcaggcatgtacaccttcatttggtcagtatttttggagtgcctactgagtaccaggccctgtgatcagggctgggtgggtgctgcacacagtaggtggccaggacacatgctggctcttggctgagacttgattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcagtcgagacaagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctctgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtccaccctga

SEQ ID NO: 143405 - DNA, 3193 bp, Homo sapiens
  Payload ID: 8328
  Gene Symbol: ITIH2
  Gene Name: inter-alpha-trypsin inhibitor heavy chain 2
  Uniprot ID: P19823
  ENST ID: ENST00000358415
  CDS Start-End: 167-3007
atttgtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctaactgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatgccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggaccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatga

SEQ ID NO: 143406 - DNA, 2848 bp, Homo sapiens
  Payload ID: 8328
  Gene Symbol: ITIH2
  Gene Name: inter-alpha-trypsin inhibitor heavy chain 2
  ENST ID: ENST00000379587
  CDS Start-End: 36-2843
ctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcaggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctaactgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatgccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggaccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtt

SEQ ID NO: 143407 - DNA, 767 bp, Homo sapiens
  Payload ID: 8328
  Gene Symbol: ITIH2
  Gene Name: inter-alpha-trypsin inhibitor heavy chain 2
  ENST ID: ENST00000429820
  CDS Start-End: 56-767
tgatatcctccccagaccatctgctttggggagcttggcaaaactgtccagcaaaatgaaaagactcacgtgctttttcatctgcttctttctttctgaagtatcaggcttcgaaatccccataaatggactttctgaaagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgcccta

SEQ ID NO: 143408 - DNA, 3086 bp, Homo sapiens
  Payload ID: 8328
  Gene Symbol: ITIH2
  Gene Name: inter-alpha-trypsin inhibitor heavy chain 2
  ENST ID: ENST00000613369
  CDS Start-End: 64-2901
ggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctaactgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttatttcagctacaaaaacacaggttgcagatgccaagatatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggaccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatg

SEQ ID NO: 143409 - DNA, 2220 bp, Homo sapiens
  Payload ID: 8329
  Gene Symbol: ITIH3
  Gene Name: inter-alpha-trypsin inhibitor heavy chain 3
  ENST ID: ENST00000416872
  CDS Start-End: 9-2105
attcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagacc

SEQ ID NO: 143410 - DNA, 3007 bp, Homo sapiens
  Payload ID: 8329
  Gene Symbol: ITIH3
  Gene Name: inter-alpha-trypsin inhibitor heavy chain 3
  Uniprot ID: Q06033
  ENST ID: ENST00000449956
  CDS Start-End: 7-2679
tcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 143411 - DNA, 3038 bp, Homo sapiens
  Payload ID: 8329
  Gene Symbol: ITIH3
  Gene Name: inter-alpha-trypsin inhibitor heavy chain 3
  ENST ID: ENST00000621946
  CDS Start-End: 37-2049
atataaggagcgtgggccaggcctgagtattcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaaggtggggatagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 143412 - DNA, 3336 bp, Homo sapiens
  Payload ID: 8330
  Gene Symbol: ITIH4
  Gene Name: inter-alpha-trypsin inhibitor heavy chain family, member 4
  Uniprot ID: Q14624
  ENST ID: ENST00000266041
  CDS Start-End: 98-2890
aacctgcccccatgtgggtggggcagcaaacaagttactaatccattccccacttgctgtcgagttcagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactacaaaaaaaaaaaaaaaa

SEQ ID NO: 143413 - DNA, 2872 bp, Homo sapiens
  Payload ID: 8330
  Gene Symbol: ITIH4
  Gene Name: inter-alpha-trypsin inhibitor heavy chain family, member 4
  Uniprot ID: Q14624
  ENST ID: ENST00000406595
  CDS Start-End: 31-2733
agaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaa

SEQ ID NO: 143414 - DNA, 2293 bp, Homo sapiens
  Payload ID: 8330
  Gene Symbol: ITIH4
  Gene Name: inter-alpha-trypsin inhibitor heavy chain family, member 4
  ENST ID: ENST00000441637
  CDS Start-End: 1-2158
ggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctg

SEQ ID NO: 143415 - DNA, 2990 bp, Homo sapiens
  Payload ID: 8330
  Gene Symbol: ITIH4
  Gene Name: inter-alpha-trypsin inhibitor heavy chain family, member 4
  ENST ID: ENST00000485816
  CDS Start-End: 32-2839
cagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctcc

SEQ ID NO: 143416 - DNA, 3132 bp, Homo sapiens
  Payload ID: 8331
  Gene Symbol: ITIH5
  Gene Name: inter-alpha-trypsin inhibitor heavy chain family, member 5
  ENST ID: ENST00000397145
  CDS Start-End: 107-2215
gaccgcggggtgggcggccccgagagcgtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagttcgtggcttcagaagggaagaacagattttttcaaatgtcatgaaatttccttttgccagcatcctggaactataataaaaattcagaggaaagaacaacctatgactgggttttgttctgctgtgtccagatcatcctctggaagtcttgattgttgcctttctgctgctgtgctgtacgtgcaagttcctaaagccagggacatcccggagatgagctgtggatatagagtccgcacagcctgcgggagacagaatgtaattccttccaacacacacacacaggctttatggaatgccagaaaagcttcctcttggatgctgcctggagtaatgactttttgaccctcccctcttttttggagcaagcactatctttccttgtaaagaaatttggacaatttgagtagaaatggtgtggtatgtgcacatagaaactctcagaaaactgtcagatgagctagacagttgtcctctatctccatgggtcccgcatcccaaggatcgaaccaacaacagatcaaaaatacgtgaaaaaggaattgcatctgtattgaatgtgtacggactttttttcttgtctttgttccttaaacaatgtagtgtaacaactatttacatcgcatctcctttgcattcattattataagtaaactagagatgatttaaagtgtatagaaaggctgcgtgcagtggctaatgtctgtaatcccagcactttgagaggccgaggcaggtggatcacctgaggtcaggagttcgagaccagcctggccaacgtggtgaaaccccatctctactaaaaatacaataattagctgggcatggtggtgcacgcctgtaatcccagctattcgggaggctgaggcaggagaatcgcttgaacccaggaggcagagattgcagtgaaccgagattgcaccattgcactccagcctgggtgacagagtgaacctccgtctcaaaaacaaaataaataaataagaataaatt

SEQ ID NO: 143417 - DNA, 6721 bp, Homo sapiens
  Payload ID: 8331
  Gene Symbol: ITIH5
  Gene Name: inter-alpha-trypsin inhibitor heavy chain family, member 5
  ENST ID: ENST00000397146
  CDS Start-End: 80-2908
gtcccgcagtggctggagccctgggcgctgcaaagcgtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgaggcaagtcagactgttgcagaggctgaaaaccaaacctttgatgacagaattctcagtgaagtctaccatcatttcccgttatgccttcactacggtttcctgcagaatgctgaacagagcttctgaagaccaggacattgagttccagatgcagattccagctgcagctttcatcaccaacttcactatgcttattggagacaaggtgtatcagggcgaaattacagagagagaaaagaagagtggtgatagggtaaaagagaaaaggaataaaaccacagaagaaaatggagagaaggggactgaaatattcagagcttctgcagtgattcccagcaaggacaaagccgcctttttcctgagttatgaggagcttctgcagaggcgcctgggcaagtacgagcacagcatcagcgtgcggccccagcagctgtccgggaggctgagcgtggacgtgaatatcctggagagcgcgggcatcgcatccctggaggtgctgccgcttcacaacagcaggcagaggggcagtgggcgcggggaagatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccggggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggacaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaatagaaacatctacagctcagatactgatctctttctaatgggctttgtaaaccacttgactttgctaatggctattctccaatttgttccaataagctaagggcttttcatacacaggacaactccatgtggttgattttactggcatgtcttggtgacgaagagttggccaagtgaatgatgcatcttttacttggagctctccagcctttgtcatagttcccagaccttttttccttgtggtcatccaggaggtgatcaattacatgtgcacagtgctaggacgggaggcagagccggctcagagcaggtccaccagcccacctatagcaggaagcgtgtcggtgcttaggaaatctaggacttccagcttccctcatgtcagatagaaaaaaagtcaggaaaccagctcgtggacaggggctttggttccaaaacttggacaaacctgatgccttaaggaaaaggttaagatgagaggggacttccagagtcaatgaacgtcacccttcagcggacggataccgggagcgcttgggcgaaacagcagagaaagaaagactgtggtcggggaagtggaatgcttcgatgcaggccagagttcaaggctctggggctggcctcacaagaggcttcttccacggggcttgacaccagagcagcccccgcgtgaaatgagaaggcatgcttagcactgggaggaaaagctgagttaagaaaattctttatcatgtttgccttccctggggaaacattcaggcagtaaaatgacatccacgtgttcctgtcggacgcagcggcttcgggaacaagttagcgctgggggactatctgggctcgtctctctctgcttcgtgaacccaccacaccagggcctgtctgctgtgctatttatttgccttccgtcttcccaacctcagctgcctgtattcatgccagaggtgcaaaggctgccagccagtgctgctgacagatgctttcagactgtagagctcagagaaagggagcggcagctagaggtagccagggagctggccaggctccccggggccttcctattatgtaaatcccagctggacagacagccctggagccaggtggccctgtcccctgtggagcacttggagcagtgatctgttgttccaggtgtaagtctcgacactgcagaaatgaggacgttattaggaaagaccagttcctactgcctgtgttgctactttaagagctgagaaaaacattccaatgagctatccatagctaacttgcttgctcagaaaaacataagtaacaaagttgagctttcatttttaaaaattatattttactttagaaaaatatcaccttttttcttcctcttctttacgtgtagatcttttttttttttttcaaatggggtcagtacctgaaagcccgaaaccccataccaagcttatagttaggacctttgcatttgataaaaaaaaaatatagtattttctgttgtccagaaaatcttcccagatagggaaactgaggcagagagtgccgtggagtggtttttgccaagtcatacaacatacttaatgcagggctacactgaacctccagaatcattttgtttgctttgaccctgtttcaccatctgggcaatcatttattttccttgagcatttataaaccagggcgagggttgttccaaaatgagtaattgaatgagatgaagaaatatgtcataattagaggagataaatctccttgttatcacaatagttaatgtgtcatgatcactgactaactgggaccttgaacaagtcagcatctctgcctttcaaaatgaaggaacattgttctctatcctcccctgacccccgacggccccatgctaggtgcaccatcttcctccatttgactttttaatgctttacaacttcaggctaaagggaggggatgttgggaggagaaaccatcacaagattccctcggtgccacagctgtgctgaggaggccggggactgggaatcggagtgggcacctctgtgtttctctagggagtaacattcaacatttaattgaatcgtgtgtcctgataggtggattaggaacaggattcattcctttaactttaacttttggctaaacgacatgccttggattgagtgtatatgtcttccccaaattcatatgttgaagcttaaatcctgaatgtgatggttcttggaattgggacctttggaaggttattgggtcttgagggcagagccctcacgaatgggattaaggcccttataagaagagacatggggccaggtgcagtggctcacacctgtaatcccaacattttgggaggccgagaagggtggatcatgaggtcaggagatggagaccatcctggccaacatggtgaaacctcgtctctactaaaaatacaaaaattagctgggcgtggtggtgcgtgcctgtagttccagctacttgggaggctgaggcaggagaatcgcttgaaccaggcagtcggaacttgtagtgagccaagatcacgccactgcactccagctggagtgacagagccaaactccgtcaaaaaaaaacaaaacaaaacaaaaaaaagacatgggagagatggtgtttttcctctccaccacctggggatacgatgagaagatggccacctgcaagccaggaagacggccctcaccagacaccatgtctgctggcaccttgatcttggacctcccagcctccagaactgtgagaaataaatgtgttttgtttaagctactcaagtctgtggtattcttgttaaggcagcccaagctgactaagacaccaaatcattcaaaacgttaattctttttctgttctttaagcttcccagaatgtacacaaacaatgctgttattaaaatttaaaggactcttggaactgtaggacatgatccagctaaaataaataacaaataacacagctaagcaaatacttataaatgtagctttaaatatttattttagttttaaataattagtggggtacgagacagttcacattcaagagacattttacttagacaaaaaatttataagagaacgatgcataaaaacaaacaacatattggtctgtttatttttctaagggaaaatggaattggagctgttgagaataaaacttgaagaatctaactgca

SEQ ID NO: 143418 - DNA, 983 bp, Homo sapiens
  Payload ID: 8331
  Gene Symbol: ITIH5
  Gene Name: inter-alpha-trypsin inhibitor heavy chain family, member 5
  ENST ID: ENST00000461751
  CDS Start-End: 1-358
cccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcaggacattggtttctccctcgctgtccaaaattgggttcccaagggctatttggatatttcatgtgtaaccttacaggtgcacgtgtaactggaaagggaaggcaaaggccaagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatc

SEQ ID NO: 143419 - DNA, 2916 bp, Homo sapiens
  Payload ID: 8331
  Gene Symbol: ITIH5
  Gene Name: inter-alpha-trypsin inhibitor heavy chain family, member 5
  ENST ID: ENST00000613909
  CDS Start-End: 71-2257
cgccttgtagacgtgttcgctttgcgtttgccttctgcgtgattgtaagtttcccgaggcttccccagccatgcggaactatgattctgggcctcccccatctactgtcattaaccaaaatgaaacatttgccaacataatttttaaacctactgtagtacaacaagccaggattgcccagaatggaattttgggagactttatcattagatatgacgtcaatagagaacagagcattggggacatccaggttctaaatggctattttgtgcactactttgctcctaaagaccttcctcctttacccaagaatgtggtattcgtgcttgacagcagtgcttctatggtgggaaccaaactccggcagaccaaggatgccctcttcacaattctccatgacctccgaccccaggaccgtttcagtatcattggattttccaaccggatcaaagtatggaaggaccacttgatatcagtcactccagacagcatcagggatgggaaagtgtacattcaccatatgtcacccactggaggcacagacatcaacggggccctgcagagggccatcaggctcctcaacaagtacgtggcccacagtggcattggagaccggagcgtgtccctcatcgtcttcctgacggatgggaagcccacggtcggggagacgcacaccctcaagatcctcaacaacacccgagaggccgcccgaggccaagtctgcatcttcaccattggcatcggcaacgacgtggacttcaggctgctggagaaactgtcgctggagaactgtggcctcacacggcgcgtgcacgaggaggaggacgcaggctcgcagctcatcgggttctacgatgaaatcaggaccccgctcctctctgacatccgcatcgattatccccccagctcagtggtgcaggccaccaagaccctgttccccaactacttcaacggctcggagatcatcattgcggggaagctggtggacaggaagctggatcacctgcacgtggaggtcaccgccagcaacagtaagaaattcatcatcctgaagacagatgtgcctgtgcggcctcagaaggcagggaaagatgtcacaggaagccccaggcctggaggcgatggagagggggacaccaaccacatcgagcgtctctggagctacctcaccacaaaggagctgctgagctcctggctgcaaagtgacgatgaaccggagaaggagcggctgcggcagcgggcccaggccctggctgtgagctaccgcttcctcactcccttcacctccatgaagctgagggggccggtcccacgcatggatggcctggaggaggcccacggcatgtcggctgccatgggacccgaaccggtggtgcagagcgtgcgaggagctggcacgcagccaggacctttgctcaagaagccataccagccaagaattaaaatctctaaaacatcagtggatggtgatccccactttgttgtggatttccccctgagcagactcaccgtgtgcttcaacattgatgggcagcccggggacatcctcaggctggtctctgatcacagggactctggtgtcacagtgaacggagagttaattggggcacccgcccctccaaatggccacaagaaacagcgcacttacttgcgcactatcaccatcctcatcaacaagccagagagatcttatctcgagatcacaccgagcagagtcatcttggatggtggggacagactggtgctcccctgcaaccagagtgtggtggtggggagctgggggctggaggtgtccgtgtctgccaacgccaatgtcaccgtcaccatccagggctccatagcctttgtcatcctcatccacctctacaaaaagccggcgcccttccagcgacaccacctgggtttctacattgccaacagcgagggcctttccagcaactgccacggactgctgggtcagttcctgaatcaggatgccagactcacagaagaccctgcagggcccagccagaacctcactcaccctctgctccttcaggtgggagaggggcctgaggccgtcctaacagtgaaaggccaccaagtcccagtggtctggaagcaaaggaagatttacaacggggaagagcagatagactgctggtttgccaggaacaatgccgccaaactgattgacggggagtacaaggattacctggcatcccatccatttgacacagggatgacacttggccggggaatgtccagggagctctgaagctggcagccttaaagatgcaagtgcatgaaggacagtgatgtggggaggccgtggggcagctcttttcatggcttgtacacgcctcagctcctggcaattagctggactccatgacccacccctggtgcagcatagatccgacgtctgtctgggcgaagggtaggggtgggtaggggcgggaagcctgagtgcaaatgtcatttccctctactgcctcttcctgcctctccccaccctgcccacatccacagaggggagagaagggtcatagctaaatgcaacaaagtctgtatcttgtcccaacctgcttttctgttctgttagcatatcataaagtaagcctttctggtgaaggaaggttgctatgaaactttttttcttggtggaaatggacaagtttaggcactctgctttttgccttacactaatgcttagaaagctgtcttttcagtggtgttgcagcccccagatgtgtggccaacctctgctgcaaaggaatctcttgctgagtccaggccaccaatcaggcaaatagcccatacatttgatcgttgtaaaccatgaagtcttttcttgcaagacgtttttcttctgctgtggtatcttgcccttaaaaattagttttcattaaaaagaaatttgattgaaaatagaaa

SEQ ID NO: 143420 - DNA, 4968 bp, Homo sapiens
  Payload ID: 8332
  Gene Symbol: ITIH6
  Gene Name: inter-alpha-trypsin inhibitor heavy chain family, member 6
  Uniprot ID: Q6UXX5
  ENST ID: ENST00000218436
  CDS Start-End: 31-3972
gaacaacagatccaggccagaggtggcatcatgtctgggtggaggtacctcatctgtgtcagctttttgctgaccattcttcttgaactgacataccagggaccccctgtccccgcttcatcaagcacaaagttgttaatgacaagctattctatgcgctccacggtggtgtctcgctatgcccacaccttggtcacctctgtcctgtttaatccacatgctgaagcccatgaagccatctttgacctggatctgcctcatcttgcctttatctccaatttcactatgaccatcaacaataaagtctacattgcagaagtcaaagagaagcaccaggcaaagaaaatctatgaagaagcccatcagcagggaaagacagctgctcatgtaggcatcagggaccgggaatcagagaagttccgcatctccaccagcctggcagcaggcacagaggtgactttttccctggcctatgaggaactgcttcagcggcaccagggccagtaccagctggtggtgagcctgaggcctggccaattggtgaagaggctgagcatagaggttacagtgtcagaaaggacaggcatctcctatgtgcacataccacccctgaggaccggccgtctgcgcaccaatgcccatgcaagtgaggtggattcacccccatccaccaggatcgagaggggagagacctgtgtccgaatcacctactgcccgacattgcaagaccagtcgtccatctctgggtcaggcatcatggctgacttcctggttcagtacgatgtggtcatggaggacatcattggagacgtgcagatttacgatgactatttcattcactactttgcccccagaggccttccacctatggagaagaatgtggtttttgttattgacgtaagcagctccatgtttggtaccaagatggaacagactaaaacggccatgaatgtgatcctcagtgaccttcaagccaatgactacttcaacatcatctccttttctgacacagttaatgtttggaaagctggaggctcaatccaggccaccatccagaatgtccacagtgccaaggactacctgcattgcatggaagccgatggctggacagacgtcaactcagctctgctggcagctgcttcagtgctgaaccatagcaaccaggagcctgggaggggccccagtgtggggaggatccctcttatcatcttcctgacggatggggagcccacggccggcgtgacgacccccagtgtgatcctctccaatgtccgtcaggcgctaggccacagggtatcccttttcagcttggcctttggggatgatgctgactttacactgctgcgccgcctgtccctggaaaaccggggaatagcccggcgcatatatgaggacactgatgcggccctacagctgaagggcctctatgaggagatctccatgcctctgctggcagatgtgcgtctgaactacctgggtggcttggttggggcctccccttgggccgttttccccaactactttggtggctctgagctggtggtggcaggacaggtgcagccaggcaaacaggaactgggcatccacctggcagcccgtggccccaaggatcagcttcttgtggcccaccacagtgaaggggccaccaacaacagccagaaggcctttggttgcccaggggagccagcccccaatgtggcccacttcatccgccgcctctgggcctatgtcaccattggagaactgctggatgcacacttccaagctcgtgacaccaccactcgccacctgctggctgccaaagtcctcaacctgtcccttgaatacaactttgtcacacctctgacttcactggtcatggtgcaacccaaacaggccagtgaggagaccaggagacagacttccacctctgctgggccagacaccatcatgccctcatccagcagcaggcatggcctaggggtaagcacagctcagccagccttggtgcccaaggtcatctcccccaaatcaaggcctgtgaaaccaaagttctacttatcctcaactactactgcctctaccaagaagatgctaagttccaaagagctggagccattgggagagagccctcataccctgtcaatgcccacatacccaaaggccaaaattccagcacaacaggattctggcaccttggcccagccaactctcaggacaaaacctaccattcttgtgccctcaaattctggtactctgttgcctctgaagcccggctctctatcacaccagaatcctgatatattacccacgaactccaggacacaagtcccacctgtgaaacctggcatcccagcctcgcccaaagctgacactgtgaaatgtgttactccactgcattccaaacctggtgctccatcgcacccccaacttggggcactcacatcacaggcacctaaaggcctgccacagtcaagacctggagtctctacacttcaggttcccaagtacccactacacaccagacctagggttcctgctcccaagacccgaaacaacatgccacacctggggcctggaatcctcttgtccaagacccctaaaatcttattatctcttaaaccgagtgccccaccacaccaaatttccacaagcatatcactttccaagcctgagaccccaaacccccatatgcctcaaaccccactacctcctagacctgacagaccaaggcccccacttcctgagagcctaagcacattcccaaatacaatctcaagttccacaggtcccagcagtaccacaaccacctctgtccttggagaacccctccccatgccctttactcccactctgccccctggaaggttctggcatcagtatgacctcctcccgggtccccagaggaccaggcaagttctgggaccatctaggccaggagttccaacaatgagcctactcaacagctccaggcctacaccagaaggcagccctccaaacctgccaatcttgctgccttctagcatcctccctgaggccatcagtctgctccttctccctgaggagctagagctgctgtctgaatcaatggtggaatccaagttcgtggagtccttgaacccaccagctttctataccttcctcactcctgatgaagatggaagtccaaactgggatggcaattctgaggagatcctgggaggagctggaggcagcatggaatctcaaggaagttctgtggggttagcaaaaggcacattgcctagcatcttcaccttctcctcctcagtggacggggacccccactttgtgatccaaatcccacactcagaagagaagatctgcttcacactgaatgggcaccctggggacttgctgcagctcatagaggacccaaaggcagggctgcatgtgagtgggaagctgcttggcgcaccaccaaggccgggccacaaggaccagactcgcacctacttccagatcatcacagtcactacagacaaaccccgggcctatactatcaccatcagccgcagttctatatctttgcgaggcgagggtaccttgcgcctgtcctgggaccaacctgccctgctgaagaggccccagctggagctctatgtggctgctgcagcccgccttaccctccgccttgggccctaccttgagttcctagtcctccgacaccgctacaggcatcccagtaccctgcaactaccccacctggggttctacgtggccaatggctcaggcctcagcccctcagcccgtggcctgatagggcagttccagcacgcagacatccgactggtgacaggacctatggggccatgcttacgaaggcaccatggcccagatgtgcctgtgattctaggcaagaggctgctgaaggactcaccaaggctgctgccccgctgggcttcctgctggctggtgaagcgctctcatgtagagctgcttctgggccacccctacctctcctatgtcctgtgatggcttctgaattccagagccaggagacctgaatttgggagatccagaaaccagggcatggggtgagccagggacagagacccaaggacatggaagcacacacagggacacacagactcacgcatgttctaaggaacacatatacaagggtatacaaacacatagacatgcagagacatagagtcagggactcctgcatcttcatggtccttcacatctccagtctcaccctctccaaatccatgctcctcaccagccctacaagccacttttgtaaaacgaaaaaatgatcagtagttctgctcacagctttccctaactcctatggcatattcaaggctctcagagtttccctaacaaaccatgctcactcctaccactggaccattgcatgtgcttttccttctgcatgaaacactcttcctttgttcctgtaggtgagtataattcatccttcaaatcctagttgttacctcttctaggaggcctttcctgatgcctgccctagattgagtttggtcctgtcctctgggttcctatagcccacccccaaccctccacgctcacagtatttatactgtgtagtaatcatctgtttacttgtctggatccctgacttagactgtgagatctttgagggcaaggaccttttctgaatcatctatgtatccccagtgcctctcacataataggtgcttagtaaatatttgttaaaagaatgaattaattaattaacaaaaaaggatcccataacatagcaatagacacacatatatacatactcacaaccaaagacacaggatcacacccggaaaaacagtgacaagggcacagatatggatggatagagggacagacatttatggaaacacaggaatcacaaaacaaacatggacataggggtatagagacataaaaagatggggacagggagccagagtggcagaatcagggacataaactcagagaaaaaggaacagatgctctctggctgca

SEQ ID NO: 143421 - DNA, 3252 bp, Homo sapiens
  Payload ID: 8333
  Gene Symbol: ICAM1
  Gene Name: intercellular adhesion molecule 1
  Uniprot ID: P05362
  ENST ID: ENST00000264832
  CDS Start-End: 326-1924
gtgattcaagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 143422 - DNA, 1296 bp, Homo sapiens
  Payload ID: 8333
  Gene Symbol: ICAM1
  Gene Name: intercellular adhesion molecule 1
  ENST ID: ENST00000423829
  CDS Start-End: 68-1000
aaaggatcacgcgccccagtcgacgctgagctcctctgctactcagagttgcaacctcagcctcgctatggctcccagcagcccccggcccgcgctgcccgcactcctggtcctgctcggggctctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggt

SEQ ID NO: 143423 - DNA, 581 bp, Homo sapiens
  Payload ID: 8333
  Gene Symbol: ICAM1
  Gene Name: intercellular adhesion molecule 1
  ENST ID: ENST00000588645
  CDS Start-End: 41-581
gagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgaga

SEQ ID NO: 143424 - DNA, 1252 bp, Homo sapiens
  Payload ID: 8334
  Gene Symbol: ICAM2
  Gene Name: intercellular adhesion molecule 2
  Uniprot ID: P13598
  ENST ID: ENST00000418105
  CDS Start-End: 274-1101
ggagaagactgaataagccgtgaactgggcagctgtgacacgcgcaccttgtcaccttgtcaccaatttcctgcccgggatcccagagctacccttcttggagcccacaggggtaaggttgagcttctcactttccctccaatgaagcgtggcagcatgggaaggattttggcagtgtcgaggtctgagttttagtccgttcccctctctgggtctcagtttctcgctggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 143425 - DNA, 1221 bp, Homo sapiens
  Payload ID: 8334
  Gene Symbol: ICAM2
  Gene Name: intercellular adhesion molecule 2
  Uniprot ID: P13598
  ENST ID: ENST00000449662
  CDS Start-End: 242-1069
ctgggttatgccctgcttatcagcagcttcccagcttcctctgcctggattcttagaggcctggggtcctagaacgagctggtgcacgtggcttcccaaagatctctcagataatgagaggaaatgcagtcatcagtttgcagaaggctagggattctgggccatagctcagacctgcgcccaccatctccctccaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactta

SEQ ID NO: 143426 - DNA, 1334 bp, Homo sapiens
  Payload ID: 8334
  Gene Symbol: ICAM2
  Gene Name: intercellular adhesion molecule 2
  Uniprot ID: P13598
  ENST ID: ENST00000412356
  CDS Start-End: 356-1183
ggagaagactgaataagccgtgaactgggcagctgtgacacgcgcaccttgtcaccttgtcaccaatttcctgcccgggatcccagagctacccttcttggagcccacaggggtaaggttgagcttctcactttccctccaatgaagcgtggcagcatgggaaggattttggcagtgtcgaggtctgagttttagtccgttcccctctctgggtctcagtttctcgctggaataaagtgaaacacctcaggctccaaccctcccaacccaaggctccctcctggagggagagagaggatggaggacatcaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 143427 - DNA, 1154 bp, Homo sapiens
  Payload ID: 8334
  Gene Symbol: ICAM2
  Gene Name: intercellular adhesion molecule 2
  Uniprot ID: P13598
  ENST ID: ENST00000579687
  CDS Start-End: 212-1039
ggcagctgtgacacgcgcaccttgtcaccttgtcaccaatttcctgcccgggatcccagagctacccttcttggagcccacaggggaataaagtgaaacacctcaggctccaaccctcccaacccaaggctccctcctggagggagagagaggatggaggacatcaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggaca

SEQ ID NO: 143428 - DNA, 892 bp, Homo sapiens
  Payload ID: 8334
  Gene Symbol: ICAM2
  Gene Name: intercellular adhesion molecule 2
  ENST ID: ENST00000583684
  CDS Start-End: 148-309
tgaataagccgtgaactgggcagctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtggccctcttcaccctgatctgctgtccaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggacttag

SEQ ID NO: 143429 - DNA, 1064 bp, Homo sapiens
  Payload ID: 8334
  Gene Symbol: ICAM2
  Gene Name: intercellular adhesion molecule 2
  ENST ID: ENST00000578379
  CDS Start-End: 387-911
tgaataagccgtgaactgggcagctgtgacacgcgcaccttgtcaccttgtcaccaatttcctgcccgggatcccagagctacccttcttggagcccacaggggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggacttag

SEQ ID NO: 143430 - DNA, 718 bp, Homo sapiens
  Payload ID: 8334
  Gene Symbol: ICAM2
  Gene Name: intercellular adhesion molecule 2
  ENST ID: ENST00000584084
  CDS Start-End: 219-718
cttgtcaccaatttcctgcccgggatcccagagctacccttcttggagcccacaggggtaaggttgagcttctcactttccctccaatgaagcgtggcagcatgggaaggattttggcagtgtcgaggtctgagttttagtccgttcccctctctgggtctcagtttctcgctggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgc

SEQ ID NO: 143431 - DNA, 713 bp, Homo sapiens
  Payload ID: 8334
  Gene Symbol: ICAM2
  Gene Name: intercellular adhesion molecule 2
  ENST ID: ENST00000583366
  CDS Start-End: 70-713
cagagctacccttcttggagcccacagggcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagat

SEQ ID NO: 143432 - DNA, 949 bp, Homo sapiens
  Payload ID: 8334
  Gene Symbol: ICAM2
  Gene Name: intercellular adhesion molecule 2
  ENST ID: ENST00000578313
  CDS Start-End: 301-949
cttgtcaccaatttcctgcccgggatcccagagctacccttcttggagcccacaggggtaaggttgagcttctcactttccctccaatgaagcgtggcagcatgggaaggattttggcagtgtcgaggtctgagttttagtccgttcccctctctgggtctcagtttctcgctggaataaagtgaaacacctcaggctccaaccctcccaacccaaggctccctcctggagggagagagaggatggaggacatcaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatg

SEQ ID NO: 143433 - DNA, 1056 bp, Homo sapiens
  Payload ID: 8334
  Gene Symbol: ICAM2
  Gene Name: intercellular adhesion molecule 2
  ENST ID: ENST00000578892
  CDS Start-End: 148-903
tgaataagccgtgaactgggcagctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcgacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggacttag

SEQ ID NO: 143434 - DNA, 1103 bp, Homo sapiens
  Payload ID: 8334
  Gene Symbol: ICAM2
  Gene Name: intercellular adhesion molecule 2
  Uniprot ID: P13598
  ENST ID: ENST00000579788
  CDS Start-End: 125-952
ctgtgacacgcgcaccttgtcaccttgtcaccaatttcctgcccgggatcccagagctacccttcttggagcccacaggggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 143435 - DNA, 1934 bp, Homo sapiens
  Payload ID: 8335
  Gene Symbol: ICAM3
  Gene Name: intercellular adhesion molecule 3
  Uniprot ID: P32942
  ENST ID: ENST00000160262
  CDS Start-End: 210-1853
gcagtgctggccactttgcagagccccgtctgggtcccccaccctggcccccaagggccacagcatccccttccacccacaggcctgggcaaggtgcagtccccagacttctgcaatcttaaccgctgtgcttccgtcgcagtgggaggccccgccttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctctcagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaa

SEQ ID NO: 143436 - DNA, 564 bp, Homo sapiens
  Payload ID: 8335
  Gene Symbol: ICAM3
  Gene Name: intercellular adhesion molecule 3
  ENST ID: ENST00000589249
  CDS Start-End: 443-564
ctcaggaaggcaccttcctctgtcagaatggccaccatggtaccatccgtgttgtggcccagggcctgctggactctgctggtctgctgtctgctgaccccaggatcacctgtccctttcacttgctaactcctacttagccttcagtttcgggctgcaatggtccccgcttccaggaagccttccctgactcacctcctcctatgctggatcagagcctcttctggcctccttctgagttctccccggtctctgatggattctacctttcccactggaccatgaaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctctcagataacaggctcctctaacatcaccgtgtacaggctcccgga

SEQ ID NO: 143437 - DNA, 1099 bp, Homo sapiens
  Payload ID: 8335
  Gene Symbol: ICAM3
  Gene Name: intercellular adhesion molecule 3
  ENST ID: ENST00000585439
  CDS Start-End: 11-190
ctctgtcagaatggccaccatggtaccatccgtgttgtggcccagggcctgctggactctgctggtctgctgtctgctgaccccagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctctcagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgtgaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatca

SEQ ID NO: 143438 - DNA, 905 bp, Homo sapiens
  Payload ID: 8335
  Gene Symbol: ICAM3
  Gene Name: intercellular adhesion molecule 3
  ENST ID: ENST00000592439
  CDS Start-End: 1-905
gaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgt

SEQ ID NO: 143439 - DNA, 584 bp, Homo sapiens
  Payload ID: 8335
  Gene Symbol: ICAM3
  Gene Name: intercellular adhesion molecule 3
  ENST ID: ENST00000590569
  CDS Start-End: 187-584
ctctgtcagaatggccaccatggtaccatccgtgttgtggcccagggcctgctggactctgctggtctgctgtctgctgaccccaggatcacctgtccctttcacttgctaactcctacttagccttcagtttcgggctgcaatggtccccgcttccaggaagccttccctgactcacctcctcctatgctggatcagagcctcttctggcctccttctgagttctccccggtctctgatggattctacctttcccactggaccatgaaggcaggaacccttctgtctcggcacaaggagagaggtgttaaatgtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctctcagataacaggctcctctaacatcaccgtgtacaggctcccggagcgtgtggagctggcacccctgcctccttggcagccggtgggccagaacttcaccctgcgctgccaagtggaggatgg

SEQ ID NO: 143440 - DNA, 658 bp, Homo sapiens
  Payload ID: 8335
  Gene Symbol: ICAM3
  Gene Name: intercellular adhesion molecule 3
  ENST ID: ENST00000592945
  CDS Start-End: 1-579
accgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatgctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccct

SEQ ID NO: 143441 - DNA, 582 bp, Homo sapiens
  Payload ID: 8335
  Gene Symbol: ICAM3
  Gene Name: intercellular adhesion molecule 3
  ENST ID: ENST00000589580
  CDS Start-End: 513-582
aaggcaccttcctctgtcagaatggccaccatggtaccatccgtgttgtggcccagggcctgctggactctgctggtctgctgtctgctgaccccagccttcagtttcgggctgcaatggtccccgcttccaggaagccttccctgactcacctcctcctatgctggatcagagcctcttctggcctccttctgagttctccccggtctctgatggattctacctttcccactggaccatgaaggcaggaacccttctgtctcggcacaaggagagaggtgttaaatggtggggcctgttgatgcgtgggttgggggacaaggaaacaaacaccaggacttcttcatgttcctgaaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgca

SEQ ID NO: 143442 - DNA, 2024 bp, Homo sapiens
  Payload ID: 8335
  Gene Symbol: ICAM3
  Gene Name: intercellular adhesion molecule 3
  ENST ID: ENST00000589261
  CDS Start-End: 534-1946
tcagaatggccaccatggtaccatccgtgttgtggcccagggcctgctggactctgctggtctgctgtctgctgaccccaggatcacctgtccctttcacttgctaactcctacttagccttcagtttcgggctgcaatggtccccgcttccaggaagccttccctgactcacctcctcctatgctggatcagagcctcttctggcctccttctgagttctccccggtctctgatggattctacctttcccactggaccatgaaggcaggaacccttctgtctcggcacaaggagagaggtgttaaatggtggggcctgttgatgcgtgggttgggggacaaggaaacaaacaccaggacttcttcatgttcctgaaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctctcagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccc

SEQ ID NO: 143443 - DNA, 1176 bp, Homo sapiens
  Payload ID: 8336
  Gene Symbol: ICAM4
  Gene Name: intercellular adhesion molecule 4 (Landsteiner-Wiener blood group)
  Uniprot ID: Q14773
  ENST ID: ENST00000340992
  CDS Start-End: 40-858
gctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaa

SEQ ID NO: 143444 - DNA, 1211 bp, Homo sapiens
  Payload ID: 8336
  Gene Symbol: ICAM4
  Gene Name: intercellular adhesion molecule 4 (Landsteiner-Wiener blood group)
  Uniprot ID: Q14773
  ENST ID: ENST00000380770
  CDS Start-End: 47-862
ggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaa

SEQ ID NO: 143445 - DNA, 1390 bp, Homo sapiens
  Payload ID: 8336
  Gene Symbol: ICAM4
  Gene Name: intercellular adhesion molecule 4 (Landsteiner-Wiener blood group)
  Uniprot ID: Q14773
  ENST ID: ENST00000393717
  CDS Start-End: 10-723
ctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagc

SEQ ID NO: 143446 - DNA, 3000 bp, Homo sapiens
  Payload ID: 8337
  Gene Symbol: ICAM5
  Gene Name: intercellular adhesion molecule 5, telencephalin
  Uniprot ID: Q9UMF0
  ENST ID: ENST00000221980
  CDS Start-End: 64-2838
gtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaataccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacggagcgggcggcggcgctggcggggcggcaggcgcggagggcggacccgaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaaggaa

SEQ ID NO: 143447 - DNA, 624 bp, Homo sapiens
  Payload ID: 8337
  Gene Symbol: ICAM5
  Gene Name: intercellular adhesion molecule 5, telencephalin
  ENST ID: ENST00000587398
  CDS Start-End: 389-624
tcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacct

SEQ ID NO: 143448 - DNA, 6139 bp, Homo sapiens
  Payload ID: 8338
  Gene Symbol: IFNAR1
  Gene Name: interferon (alpha, beta and omega) receptor 1
  Uniprot ID: P17181
  ENST ID: ENST00000270139
  CDS Start-End: 153-1826
agaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagaaaggattgaaaatatttattccagacataaaatttataaactctcaccagagactacttattgtctaaaagttaaagcagcactacttacgtcatggaaaattggtgtctatagtccagtacattgtataaagaccacagttgaaaatgaactacctccaccagaaaatatagaagtcagtgtccaaaatcagaactatgttcttaaatgggattatacatatgcaaacatgacctttcaagttcagtggctccacgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagacctctgattcaaaacttattagaacagtagcttctgctggaatttgcaatcactgaagtcatagaaaataggtaactatctaattagagaaataattgttgtattttaagatctgagagtgtgtacaagttttagtatacatgccatgccagaagatagtgtatgcaagaagtcttgggaccagaaaatggcaatgataggagactgacatagaagaagaatgcttccctaggaaaaaggtcgctggctttggtgcaagaggaagaagaatgttccactggaagcctgagcacctaatcagctctcagtgatcaacccactcttgttatgggtggtctctgtcactttgaatgccaggctggcttctcgtctagcagtattcagataccccttctgctcagcctgcttggcgttaaaatacaaatcattgaactgagggggaaaaatgtaactaggaagaaaaacccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcaccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttctgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattgtgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtattgcatagccttgctttcttgaactaaactgtttgcccttcacaagtagttcttctttcaggattagttcgttccaaggaggctcttcagtctcacagataagtagatctctcctgctgtctggacacatttcactcggaaattgaatacaatttgtattcaggctgggaacctgaacacacacttgtgtttttaagcttcccttttttacagtggacaaggacacaaataataaataaatcatccctaatgcccaagaaatgccctggtacttagtaataacaaaataccagtaacttc

SEQ ID NO: 143449 - DNA, 491 bp, Homo sapiens
  Payload ID: 8338
  Gene Symbol: IFNAR1
  Gene Name: interferon (alpha, beta and omega) receptor 1
  ENST ID: ENST00000442071
  CDS Start-End: 84-491
gtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagtagaggtcgacatcatagatgacaactttatcctgaggtggaacaggagcgatgagtctgtcgggaatgtgactttttcattcgattatcaaaaaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaagttgaaaatgaactacctccaccagaaaatata

SEQ ID NO: 143450 - DNA, 2606 bp, Homo sapiens
  Payload ID: 8339
  Gene Symbol: IFNAR2
  Gene Name: interferon (alpha, beta and omega) receptor 2
  Uniprot ID: P48551
  ENST ID: ENST00000342101
  CDS Start-End: 165-884
cgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaa

SEQ ID NO: 143451 - DNA, 2899 bp, Homo sapiens
  Payload ID: 8339
  Gene Symbol: IFNAR2
  Gene Name: interferon (alpha, beta and omega) receptor 2
  Uniprot ID: P48551
  ENST ID: ENST00000342136
  CDS Start-End: 327-1874
cccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaa

SEQ ID NO: 143452 - DNA, 1127 bp, Homo sapiens
  Payload ID: 8339
  Gene Symbol: IFNAR2
  Gene Name: interferon (alpha, beta and omega) receptor 2
  ENST ID: ENST00000382238
  CDS Start-End: 114-707
gtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagggagaagatgagaaactagacatcagtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatg

SEQ ID NO: 143453 - DNA, 1389 bp, Homo sapiens
  Payload ID: 8339
  Gene Symbol: IFNAR2
  Gene Name: interferon (alpha, beta and omega) receptor 2
  Uniprot ID: P48551
  ENST ID: ENST00000382264
  CDS Start-End: 354-1349
gcccccgcgccggcggcggcgcggcgcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctg

SEQ ID NO: 143454 - DNA, 4284 bp, Homo sapiens
  Payload ID: 8339
  Gene Symbol: IFNAR2
  Gene Name: interferon (alpha, beta and omega) receptor 2
  Uniprot ID: P48551
  ENST ID: ENST00000404220
  CDS Start-End: 330-1325
gcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatacggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccaggaagcggaggttgcagtgagccaagatcatgtcactgcacttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggt

SEQ ID NO: 143455 - DNA, 719 bp, Homo sapiens
  Payload ID: 8339
  Gene Symbol: IFNAR2
  Gene Name: interferon (alpha, beta and omega) receptor 2
  ENST ID: ENST00000417007
  CDS Start-End: 1-165
tttaccaaccacattaatgtgatggtgaaatttccatctattgttgaggaagaattacagtttgatttatctctcgtcattgaagaacagtcagagggaattgttaagaagggagaagatgagaaactagacatcagtcagttttgtcacagacaagctctgtgaccttggagaagttacttagccacactgagctacagttttctcatccgttgaatggagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctga

SEQ ID NO: 143456 - DNA, 726 bp, Homo sapiens
  Payload ID: 8339
  Gene Symbol: IFNAR2
  Gene Name: interferon (alpha, beta and omega) receptor 2
  ENST ID: ENST00000447980
  CDS Start-End: 115-726
gcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaag

SEQ ID NO: 143457 - DNA, 841 bp, Homo sapiens
  Payload ID: 8339
  Gene Symbol: IFNAR2
  Gene Name: interferon (alpha, beta and omega) receptor 2
  ENST ID: ENST00000443073
  CDS Start-End: 155-841
catctctcgggagccgcaaggcgagagctgcaaagattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaattttcataactttttagcctggccatttcctaacctgccaccgttggaagccatggatatg

SEQ ID NO: 143458 - DNA, 710 bp, Homo sapiens
  Payload ID: 8339
  Gene Symbol: IFNAR2
  Gene Name: interferon (alpha, beta and omega) receptor 2
  ENST ID: ENST00000413881
  CDS Start-End: 155-658
catctctcgggagccgcaaggcgagagctgcaaagattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaattttcataactttttagcctggccatttcctaacctgccaccgttggaagccatggatatg

SEQ ID NO: 143459 - DNA, 2139 bp, Homo sapiens
  Payload ID: 8340
  Gene Symbol: IFNGR1
  Gene Name: interferon gamma receptor 1
  Uniprot ID: P15260
  ENST ID: ENST00000367739
  CDS Start-End: 123-1592
gcctcctgccgacgccggcacagaccccggtgacggaagtgacgtaaggccggggctggagggcagtgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactcg

SEQ ID NO: 143460 - DNA, 753 bp, Homo sapiens
  Payload ID: 8340
  Gene Symbol: IFNGR1
  Gene Name: interferon gamma receptor 1
  ENST ID: ENST00000458076
  CDS Start-End: 123-753
gcctcctgccgacgccggcacagaccccggtgacggaagtgacgtaaggccggggctggagggcagtgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaag

SEQ ID NO: 143461 - DNA, 748 bp, Homo sapiens
  Payload ID: 8340
  Gene Symbol: IFNGR1
  Gene Name: interferon gamma receptor 1
  ENST ID: ENST00000414770
  CDS Start-End: 264-748
gcctcctgccgacgccggcacagaccccggtgacggaagtgacgtaaggccggggctggagggcagtgctgggctggtcccgcaggcgctcggggttggagccagcgaccgtcggtagcagcatggctctcctctttctcctaccccttgtcatgcagggtgtgagcagggctgagatgggcaccgcggatctggggccgtcctcagtggccataatataattgtgataatgtaataaaatcaggaaacattacctgaagcagatgcttttgaagtcaccagaaaatagtcttctccaattccaatttaaatatggagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgta

SEQ ID NO: 143462 - DNA, 2055 bp, Homo sapiens
  Payload ID: 8340
  Gene Symbol: IFNGR1
  Gene Name: interferon gamma receptor 1
  ENST ID: ENST00000543628
  CDS Start-End: 44-868
ccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactcttttgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacagtatccagtactcctggttcctaggtgagcaggtgatgccccagggacctttgtagccacttcactttttttcttttctctgccttggtatagcatatgtttttgtaagtttatgcatacagtaattttaagtaatttcagaagaaattctgcaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 143463 - DNA, 2221 bp, Homo sapiens
  Payload ID: 8341
  Gene Symbol: IFNGR2
  Gene Name: interferon gamma receptor 2 (interferon gamma transducer 1)
  Uniprot ID: P38484
  ENST ID: ENST00000290219
  CDS Start-End: 649-1662
gttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaaagcccgggggtctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgctgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtcta

SEQ ID NO: 143464 - DNA, 1742 bp, Homo sapiens
  Payload ID: 8341
  Gene Symbol: IFNGR2
  Gene Name: interferon gamma receptor 2 (interferon gamma transducer 1)
  ENST ID: ENST00000381995
  CDS Start-End: 113-1183
gccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagcacagctaactttggagacctaccaagaatggtgcaatgattcagcagctactcatgaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtcta

SEQ ID NO: 143465 - DNA, 1684 bp, Homo sapiens
  Payload ID: 8341
  Gene Symbol: IFNGR2
  Gene Name: interferon gamma receptor 2 (interferon gamma transducer 1)
  ENST ID: ENST00000405436
  CDS Start-End: 368-1144
ggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagctaactttggagacctaccaagaatggtgcaatgattcagcagctactcatgaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagt

SEQ ID NO: 143466 - DNA, 727 bp, Homo sapiens
  Payload ID: 8341
  Gene Symbol: IFNGR2
  Gene Name: interferon gamma receptor 2 (interferon gamma transducer 1)
  ENST ID: ENST00000421802
  CDS Start-End: 1-182
acgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagaggtttaaaagacaagaaacaaaatgatgaaaaagtgtgaccggcctgagagttcagagcctctgaagtgtcaagggatccacagtgcaggtaggatgaagagtctgagaagggagatgggatcctccgaaaagagaaaatcgggtcttacagcgcgatgtaagacgatgcggatgccacttccctcccaccccgtcccgtccgaggcctccgccccctgcccctccgcaccccccgacccaggcacgcgcagcggggagcagcccagcctagcccgtctcactgctttggttttgaaaggtcacgtatttaccttagaatttcagcaccttccaacttactgttttaagtacctttaaccagcctattggctaaaaaccgaaacggtcctacccgcgactaccactgctccagtgacaatgctctgctgctacttatttaacggagctcaaggtttataattctcgaaagaatgttgttccccttccctttcccctcccgcctctgtacttgactctcgtaagaatgaaatcagaaaagtgcagaaaacaca

SEQ ID NO: 143467 - DNA, 906 bp, Homo sapiens
  Payload ID: 8341
  Gene Symbol: IFNGR2
  Gene Name: interferon gamma receptor 2 (interferon gamma transducer 1)
  ENST ID: ENST00000439213
  CDS Start-End: 118-330
ggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagcacagctaactttggagacctaccaagaatggtgcaatgattcagcagctactcatgagatgggagatggtgaacaggcgtgtggagggcggaataatggtccccaaagatgtccacgccctcatcctcagagtccgtgaacctgggaatgtgctgcctgacgtacaaaagggactccgcagatgtgaaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggata

SEQ ID NO: 143468 - DNA, 966 bp, Homo sapiens
  Payload ID: 8341
  Gene Symbol: IFNGR2
  Gene Name: interferon gamma receptor 2 (interferon gamma transducer 1)
  ENST ID: ENST00000545369
  CDS Start-End: 104-217
gccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagcaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagat

SEQ ID NO: 143469 - DNA, 1500 bp, Homo sapiens
  Payload ID: 8341
  Gene Symbol: IFNGR2
  Gene Name: interferon gamma receptor 2 (interferon gamma transducer 1)
  Uniprot ID: P38484
  ENST ID: ENST00000576463
  CDS Start-End: 1-941
accctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtcta

SEQ ID NO: 143470 - DNA, 716 bp, Homo sapiens
  Payload ID: 8341
  Gene Symbol: IFNGR2
  Gene Name: interferon gamma receptor 2 (interferon gamma transducer 1)
  ENST ID: ENST00000572016
  CDS Start-End: 1-140
cacagctaactttggagacctaccaagaatggtgcaatgattcagcagctactcatgagatgggagatggtgaacaggcgtgtggagggcggaataatggtccccaaagatgtccacgccctcatcctcagagtccgtgaacctgggaatgtgctgcctgacgtacaaaagggactccgcagatgtgaaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggata

SEQ ID NO: 143471 - DNA, 727 bp, Homo sapiens; identical to SEQ ID NO: 143466
  Payload ID: 8341
  Gene Symbol: IFNGR2
  Gene Name: interferon gamma receptor 2 (interferon gamma transducer 1)
  ENST ID: ENST00000575304
  CDS Start-End: 1-182

SEQ ID NO: 143472 - DNA, 1557 bp, Homo sapiens
  Payload ID: 8341
  Gene Symbol: IFNGR2
  Gene Name: interferon gamma receptor 2 (interferon gamma transducer 1)
  ENST ID: ENST00000573079
  CDS Start-End: 1-998
cacagctaactttggagacctaccaagaatggtgcaatgattcagcagctactcatgaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtcta

SEQ ID NO: 143473 - DNA, 790 bp, Homo sapiens
  Payload ID: 8341
  Gene Symbol: IFNGR2
  Gene Name: interferon gamma receptor 2 (interferon gamma transducer 1)
  ENST ID: ENST00000573887
  CDS Start-End: 1-41
caccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagat

SEQ ID NO: 143474 - DNA, 1533 bp, Homo sapiens
  Payload ID: 8341
  Gene Symbol: IFNGR2
  Gene Name: interferon gamma receptor 2 (interferon gamma transducer 1)
  ENST ID: ENST00000571550
  CDS Start-End: 1-993
ctaactttggagacctaccaagaatggtgcaatgattcagcagctactcatgaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagt

SEQ ID NO: 143475 - DNA, 844 bp, Homo sapiens
  Payload ID: 8342
  Gene Symbol: IFITM1
  Gene Name: interferon induced transmembrane protein 1
  Uniprot ID: P13164
  ENST ID: ENST00000328221
  CDS Start-End: 340-717
cgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctggggccaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctac

SEQ ID NO: 143476 - DNA, 855 bp, Homo sapiens
  Payload ID: 8342
  Gene Symbol: IFITM1
  Gene Name: interferon induced transmembrane protein 1
  Uniprot ID: P13164
  ENST ID: ENST00000408968
  CDS Start-End: 319-696
ctagtcctgacttgagtttctgatgaggaagcctctctccttagccttcagcctttcctcccaccctgccataaagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctggggccaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 143477 - DNA, 730 bp, Homo sapiens
  Payload ID: 8342
  Gene Symbol: IFITM1
  Gene Name: interferon induced transmembrane protein 1
  Uniprot ID: P13164
  ENST ID: ENST00000528780
  CDS Start-End: 194-571
gtcagttctccccagagtccccgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgagccagaagatgcacaaggaggaacatgaggtggctgtgctggggccaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 143478 - DNA, 3706 bp, Homo sapiens
  Payload ID: 8343
  Gene Symbol: IFITM10
  Gene Name: interferon induced transmembrane protein 10
  Uniprot ID: A6NMD0
  ENST ID: ENST00000340134
  CDS Start-End: 150-836
aagggttcagagtcaggcacaggcaggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccgggggactttggagagggtcgaggctcagtgggagctggaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaatcctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcatgcctgacctgctggcgctccctgtccactgcactcctcccacctcatttttatgtgattttgcacagtgcctggcagacatttgacattcaataaacattgtacgaacgaaagaa

SEQ ID NO: 143479 - DNA, 3807 bp, Homo sapiens
  Payload ID: 8343
  Gene Symbol: IFITM10
  Gene Name: interferon induced transmembrane protein 10
  ENST ID: ENST00000382123
  CDS Start-End: 139-525
gtcaggcacaggcaggcagacaggaccccaagcaggactggccttccagacaggaaagagggttgcggagacacaggaggccagttgagagtggcagaggagaaaggagtttcatgggaggatggggcttggagagagatgagggagggaaaacgggggccgccatgcatcctcagcttccgggggactttggagagggtcgaggctcagtgggagctggaggttgggccgctgggaggcggatcagtggacagacagcggcccgcgggacggcggaaggacgcgcgcaccgaggctcagggggtccggccgcgcgccgaggagtcgcttgtaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaatcctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcatgcctgacctgctggcgctccctgtccactgcactcctcccacctcatttttatgtgattttgcacagtgcctggcagacatttgacattcaataaacattgtacgaacgaaagaa

SEQ ID NO: 143480 - DNA, 3020 bp, Homo sapiens
  Payload ID: 8343
  Gene Symbol: IFITM10
  Gene Name: interferon induced transmembrane protein 10
  ENST ID: ENST00000630256
  CDS Start-End: 1-150
gtgcgagacaagaagcttctcaatgacctgaatggagccgtggaggatgcaaagacggcccggctgttcaacatcaccagttctgccctggcagcctcctgcatcatcctcgtcttcatcttcctgcggtaccccctcaccgactactaaggcccgccaggcacggctgctggcggagacaagcactgagacatgtttattctcatggtccctgaaacgcaggatcccatgaggttggggcagggcagggcttcttgtcctggggcccccttgagctgtgaactgggcagcaaggccatcagaagctgagtacagcaagggggcagtgagcttggccctcagtccaccccctccgcctcctggcctccaccctgcctgtgtctggggcctgggggcttctcccctcgctgctgcaccctggcttccagcgtctgtgtccctgccctcacgtgccccttcccaggctcctggggccccttggacctgacacctagcaggaagggcttatgcaaaattgtcccaggttgggaggactcactctgtgctccccgaccctgcctcctccacgatgtgaccccgctcagagcccttgtgtctgtgaactttcaatgaaatacccatgcagctccagcccagccttctactttgtgtccctggcagggcctggagaagtctggaggctttgcaatcctccctcaggaactgcctggcggtcagggccccgggtgctgtgtcccaacagactgcaggggacggtctgctccatcacagctgtgccagacagtgaatgggaagggggggcatttggtggaggtaccccaaactcgagtcacttagagggtcaggcagcctcctggggggacggaagggggtggggcacagcctcagctgcctgcattggccaaatcagagcaaaggaaaccacaaattcactcggaaggaagcagcaggcagagacgatagacgcctggctaacccctgtccctcctggagggctctgggacctggacaggcccctttacctctctcgtgcccatctccttagctgtaaaataggaaaatggcctttcacttctataatcactgtgaaaatgaacggaagatgcctttcaaaggccgaggccagcgccctgacggcccatggcatgtgcagtccacaatgtgggaggcaggatgcagggatgggctctgtccccttggaactcaggcacagtcatgggggtgccggtcagccctgaagacaagctgatgagggtgcactaggaaaagtgcagggcatcggcgaggcacacgaaggaggtggggaggtgaagatggagaagaagccgaggcagtggccatgggtgtggagcttcgcgctgtgggtgcccagctggtctgggaaaccgcaggaaatcccgcagctcaggtgcgcagtgggaaggacttgctattccgtgggaaggcaggcaaaccttcccagggaaggggcatggccgtgcgcctcatgttttgggaagctcgtgccctctggggtagcgaggccagcttggaggggagtccagtggacagaggtggatgcaagtggagggagctgagcctgggctggggctggcagcagagggctggacagcagggcgcctgcgtggcagctgtgcagtcagtggggttgactggtttggaaggtaaggtgggggagaagcccggaggattcctgtcccttgacttggacagcccagtggagagggctgtgtaccaagggcaggaaaccagggagaagaagatgttgactttaagataccaagcagagaagggaagagccttctgggctggagacgtggggtgcctcagaagggaggaccttgagctagcagcagatgggacaaacgcaggggacagggcacagccgtggcaggagtgcagcgagcaagattctggtcacagtcctgacccagaaacctgcagaggaagggagggtggccagcacctgcccgtgggcctggggtgcagcccaggcagaggtggatggagggggtgctcagggaagaggggaggggagtgtgtgacctcaaaatgggagggcttgggggtcagagtcgagagaggggacagggtggggaccatgtgggactcttgagcactgacccttgaacccaggcagtggtgggatgggagggcaggaggcggcgggctgcgaggctgatgcggggctgcacggagctgtcattgagcctcttggaggatggtgggagaagtgccaggggcggctgaaagccttgccgagactgtgggcagcctggttgtgggcacttcggatgcttgcaccattagacccagaggcttcctggacaagcctgggctggaagaggatggcagaggctgctgggccttggaagagagagggtcctggcttctagttcctggggcagctaaggccaaccccagtgtccaggtgtcttccatgttatgcctgggagggaagaaagtagaggggcaaatgctttctttgcctattttccttaaacatttggtggcagtgctggtggctgcctgggacaggggccaggaggaaacacccctgcattagggaagccctcagccagcttttccctgggatgttcctgcgcctggctgaagctttctgagttcatgttggggaaatggaacggtcaccttccagccagtaaaggcacccctagctcttgggatgtttgtatccaactccgggcaatgtggggctacaaaggcccctggcttccataccctggggaccgggggagggctggtgctcccgcggtgggtgtccacggtgaggtcaggcccccacagcaggtgcattctcgccctcagcaggcaggcaagcaggcatcagctccggcgctggtctctggcttcgaagtctgtgtctttgcctgtctgtactcatgcctgacctgctggcgctccctgtccactgcactcctcccacctcatttttatgtgattttgcacagtgcctggcagacatttgacattcaataaacattgtacgaacgaaagaa

SEQ ID NO: 143481 - DNA, 382 bp, Homo sapiens
  Payload ID: 8344
  Gene Symbol: IFITM2
  Gene Name: interferon induced transmembrane protein 2
  ENST ID: ENST00000399815
  CDS Start-End: 1-223
gggcttcatagcattcgcgtactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 143482 - DNA, 659 bp, Homo sapiens
  Payload ID: 8344
  Gene Symbol: IFITM2
  Gene Name: interferon induced transmembrane protein 2
  Uniprot ID: Q01629
  ENST ID: ENST00000399817
  CDS Start-End: 31-429
atcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 143483 - DNA, 634 bp, Homo sapiens
  Payload ID: 8344
  Gene Symbol: IFITM2
  Gene Name: interferon induced transmembrane protein 2
  ENST ID: ENST00000527146
  CDS Start-End: 1-167
ccgtgatccacatccgcagcgagacctccgtgcctgaccatgtggtctggtccctgttcaacaccctcttcatgaacacctgctgcctgggcttcatagcattcgcgtactccgtgaagactggcacccaggctctcccagaaagtgagaagggaactcacaggtgacttcaccccatggtggggagaacagcctgtgctggggccaaggcagaaggaggatgagccccgaggctcctggagagtctgagccggtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttct

SEQ ID NO: 143484 - DNA, 588 bp, Homo sapiens
  Payload ID: 8344
  Gene Symbol: IFITM2
  Gene Name: interferon induced transmembrane protein 2
  ENST ID: ENST00000533141
  CDS Start-End: 185-523
gtgcccgccatcacacccggctaatttttttttgtatatttagtagagacggggtttcaccgtgttagccaggatggtctcgatctcctgacctcatgatcctcccacctcagcctcccaaagtgctgggattacaggcgtgagccacggcgcccggcagagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttcc

SEQ ID NO: 143485 - DNA, 605 bp, Homo sapiens
  Payload ID: 8344
  Gene Symbol: IFITM2
  Gene Name: interferon induced transmembrane protein 2
  ENST ID: ENST00000602569
  CDS Start-End: 37-375
tctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggt

SEQ ID NO: 143486 - DNA, 892 bp, Homo sapiens
  Payload ID: 8344
  Gene Symbol: IFITM2
  Gene Name: interferon induced transmembrane protein 2
  Uniprot ID: Q01629
  ENST ID: ENST00000616316
  CDS Start-End: 267-665
agtctccaggaccccacaccactaacaagatgagacttgtgctcctttgggctctagagaggaagcccctcttagccctcagcccctctttcctccctctcctaaagtaatttgatcctcaggaatttgttctgcccttatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttct

SEQ ID NO: 143487 - DNA, 808 bp, Homo sapiens
  Payload ID: 8345
  Gene Symbol: IFITM3
  Gene Name: interferon induced transmembrane protein 3
  Uniprot ID: Q01628
  ENST ID: ENST00000399808
  CDS Start-End: 238-639
tgctcccttgggctctagagaggaagcccctcttagccctcagcccctctttcctccctctcctaaagtaatttgatcctcaggaatttgttccgccctcatctggccccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtgctgctg

SEQ ID NO: 143488 - DNA, 543 bp, Homo sapiens
  Payload ID: 8345
  Gene Symbol: IFITM3
  Gene Name: interferon induced transmembrane protein 3
  ENST ID: ENST00000526811
  CDS Start-End: 140-478
gagacggggtttcaccgtgtcagccaggatggtctcgatctcctgacctcatgatcctcccacctcagcctcccaaagtgctgggattacaggcgtgagccgcggcgcccggcagagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttcc

SEQ ID NO: 143489 - DNA, 713 bp, Homo sapiens
  Payload ID: 8345
  Gene Symbol: IFITM3
  Gene Name: interferon induced transmembrane protein 3
  ENST ID: ENST00000602735
  CDS Start-End: 310-648
tcctcagagcgcagccaggccagaggctgcaccgaggtgcagaatcagaggaggcaccggagaccccagagtccagtctgagacggcacagggagcaggtctctggtggccttgacaagctccaggatagggtggggaggggactggaccctggggacctcagagcagagcaggggaaacaggagcccccacctggggagagggggcctcctctccaggaaccccaatcaagacgagcctcacgtgactcccacttcctcttggagggtgcaggggcctctcctgagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttcc

SEQ ID NO: 143490 - DNA, 500 bp, Homo sapiens
  Payload ID: 8345
  Gene Symbol: IFITM3
  Gene Name: interferon induced transmembrane protein 3
  ENST ID: ENST00000531688
  CDS Start-End: 1-167
ccgtgatccacatccgcagcgagacctccgtgcccgaccatgtcgtctggtccctgttcaacaccctcttcatgaacccctgctgcctgggcttcatagcattcgcctactccgtgaagactggcacccaggctctcccagaaagtgagaagggaactcacaggtgacttcaccccatggtggggagaacagcctgtgctgaggtcaaggcagaaggaggatgagccccgaggctcctggagagtctgagcccggtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgag

SEQ ID NO: 143491 - DNA, 736 bp, Homo sapiens
  Payload ID: 8346
  Gene Symbol: IFITM5
  Gene Name: interferon induced transmembrane protein 5
  Uniprot ID: A6NNB3
  ENST ID: ENST00000382614
  CDS Start-End: 37-435
accagtctgagtgtggaagagacggcgctggaacccatggacacggcgtatccccgcgaggacacccgggcccccacgcccagcaaggccggtgcccacacagccctcacactgggggccccgcaccccccgcctcgagaccacttgatctggtcggtgttcagcaccctctacctgaatctgtgttgcctcggcttcctggcgctggcctactccatcaaggcccgagatcagaaggtggttggtgacctggaagcggcccggcgttttggctccaaagccaagtgctacaacatcctggccgcgatgtggacgctggtgccgccactgctgctcctggggctggtggtgactggtgccctgcacctggcccggctggccaaggactctgccgccttcttcagcaccaagtttgatgacgcggactatgactgacaggctgggtcctgatctggggcactagccccaggacactgaccccaggctgctgcccctggggcccaatactgactccccggagcctggccctccttctgtggggcctccatccctgccccatcctgatcctggggccctccagccccaacatgggcacctaaggctgaaccagtcagaccccggggtcttcaccctaacccgagagttcccgggccctaactctgcccccgatcctgcccctccctcctcacactccaggcccctcggttccacgattaaaagtgcctggttccagaaa

SEQ ID NO: 143492 - DNA, 3595 bp, Homo sapiens
  Payload ID: 8347
  Gene Symbol: IFIH1
  Gene Name: interferon induced with helicase C domain 1
  Uniprot ID: Q9BYX4
  ENST ID: ENST00000263642
  CDS Start-End: 397-3474
aacagaaaccaaagtcaggcaaactctgtaagaactgcctgacagaaagctggactcaaagctcctacccgagtgtgcagcaggatcgccccggtccgggaccccaggcgcacaccgcagagtccaaagtgccgcgcctgccggccgcacctgcctgccgcggccccgcgcgccgccccgctgcccacctgcccgcctgcccacctgcccaggtgcgagtgcagccccgcgcgccggcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggattagcacttgattgaagattcttttaaaatactatcagttaaacatttaatatgattatgattaatgtattcattatgctacagaactgacataagaatcaataaaatgattgttttactctgca

SEQ ID NO: 143493 - DNA, 1617 bp, Homo sapiens
  Payload ID: 8347
  Gene Symbol: IFIH1
  Gene Name: interferon induced with helicase C domain 1
  Uniprot ID: Q9BYX4
  ENST ID: ENST00000421365
  CDS Start-End: 378-1043
caaactctgtaagaactgcctgacagaaagctggactcaaagctcctacccgagtgtgcagcaggatcgccccggtccgggaccccaggcgcacaccgcagagtccaaagtgccgcgcctgccggccgcacctgcctgccgcggccccgcgcgccgccccgctgcccacctgcccgcctgcccacctgcccaggtgcgagtgcagccccgcgcgccggcctgagagccctgtggacaacctcgtcattgtcaggcacagagcggtagaccctgcttctctaagtgggcagcggacagcggcacgcacatttcacctgtcccgcagacaacagcaccatctgcttgggagaaccctctcccttctctgagaaagaaagatgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcaggtatttgtaattttactgaggaagattcttcaaattctgcctagtgattgagaattcaataaagcagaaagacacaatgctaaacaccaagatttttagaatcaaaattttaagagtggaacatatgtgatagatcatctattttatcaccttaacaaatgaggaaattgatgcctgggaaaatatcaactgatcaaagaccatttttcatccaaccaacactctttctactaccttattttaaaaacaatatgactaccagaaattttatcaagattatgtaacattaaatatacacaaatacattggaagaaagtattttagtggttataaaaaatctgctgcatattcttctgaacatttttatacattttaagcaatgtattaagcatttgataaaaggattgttttgtcaatatatctcaaccttacctaatgtgagattttaaacagcattcaataatagtaataacataacattttatagctccttctcctacattatttgtaaatctcacttaaactgctatcttatttttcttttcgtagtatgcatcctatgtttccaaaaatatcatatgaaagacaaattgaaagttaactattaattaattataa

SEQ ID NO: 143494 - DNA, 3579 bp, Homo sapiens
  Payload ID: 8348
  Gene Symbol: IRF1
  Gene Name: interferon regulatory factor 1
  Uniprot ID: P10914
  ENST ID: ENST00000245414
  CDS Start-End: 260-1237
tgctcggtggcgccgctgccctggcagagctcgccactccttagtcgaggcaagacgtgcgcccgagccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcacctgaggtcaggagttcgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcaccaaaaaaaaaaaaaaaaaaaaaaacctttcatttggccgggcatggtggcttatgcctgtaatcctggcactttgggaggccaaggtgggcagatcacctgaggtcaggagtttgagaccagcctggccaacatggtgaaacctcatctctactaaaaatacaaaaattaggccgggcacggtggctcacgcctgtaatcccagcactttgggaggcagaggcgggcggatcacgaggtcaggagatcaagaccatcctggctaacacggtgaaaccccgtctctactaaaaatataaaaaattagccgggcctagtggcgggtgcctgtagtcccagctactcgggaggctgaggcaggagaatggcatgaaccccggaggcagagcttgcagtgagccgagattgcaccactgcactacagcctgggcgacagagcgagactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtca

SEQ ID NO: 143495 - DNA, 2061 bp, Homo sapiens
  Payload ID: 8348
  Gene Symbol: IRF1
  Gene Name: interferon regulatory factor 1
  Uniprot ID: P10914
  ENST ID: ENST00000405885
  CDS Start-End: 219-1196
cccgctatgttcgtcccgcgcatccacacgccgtgccggggaccgagtgtcagcccacgcgtgggcgcccagtgctcccggctttcggcggtcccagctccgcgcccaggcgacaggttttgggctccctgtgctggtggcaagggctggcttactgcccaggtggctggagggaatcgtgacctacggagactgcgggaagaggcgccacagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaattgttta

SEQ ID NO: 143496 - DNA, 524 bp, Homo sapiens
  Payload ID: 8348
  Gene Symbol: IRF1
  Gene Name: interferon regulatory factor 1
  ENST ID: ENST00000439555
  CDS Start-End: 188-343
ccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctga

SEQ ID NO: 143497 - DNA, 885 bp, Homo sapiens
  Payload ID: 8348
  Gene Symbol: IRF1
  Gene Name: interferon regulatory factor 1
  ENST ID: ENST00000458069
  CDS Start-End: 309-885
cgcagatctgcgtgcgcgcagccgccaggggcctgtaggtggcccgctatgttcgtcccgcgcatccacacgccgtgccggggaccgagtgtcagcccacgcgtgggcgcccagtgctcccggctttcggcggtcccagctccgcgcccaggcgacaggttttgggctccctgtgctggtggcaagggctggcttactgcccaggtggctggagggaatcgtgacctacggagactgcgggaagaggcgccacaggtgttccttgggccacttctccagaggaggggaaaccgggccggaaggccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctcc

SEQ ID NO: 143498 - DNA, 832 bp, Homo sapiens
  Payload ID: 8348
  Gene Symbol: IRF1
  Gene Name: interferon regulatory factor 1
  ENST ID: ENST00000437654
  CDS Start-End: 239-832
tggcagagctcgccactccttagtcgaggcaagacgtgcgcccgagccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagctacaacagatgaggatgaggaagggaaattacctgaggacatcatgaag

SEQ ID NO: 143499 - DNA, 523 bp, Homo sapiens
  Payload ID: 8348
  Gene Symbol: IRF1
  Gene Name: interferon regulatory factor 1
  ENST ID: ENST00000476613
  CDS Start-End: 168-523
agagcagttttattccagcgcagctcccctccgcactgagtgtagtacctagcagctggctgaggtgaggggagggtaactaagtgacctcgggtggggcaggtcactgcccaggtactgttcaacagattccagactggagcctctgtgttctctttacagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaacca

SEQ ID NO: 143500 - DNA, 821 bp, Homo sapiens
  Payload ID: 8348
  Gene Symbol: IRF1
  Gene Name: interferon regulatory factor 1
  ENST ID: ENST00000613424
  CDS Start-End: 117-722
cctctgccttcttccctcttccactcggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcg

SEQ ID NO: 143501 - DNA, 2303 bp, Homo sapiens
  Payload ID: 8349
  Gene Symbol: IRF2
  Gene Name: interferon regulatory factor 2
  Uniprot ID: P14316
  ENST ID: ENST00000393593
  CDS Start-End: 209-1258
ggatttccagccgcggctcttcgcagtttcctctccttgttttgctttcgatctggactgttctcaggcaagccggggagtaacttttagttttgctcctgcgattattcaactgacgggctttcatttccatttcacataccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatca

SEQ ID NO: 143502 - DNA, 586 bp, Homo sapiens
  Payload ID: 8349
  Gene Symbol: IRF2
  Gene Name: interferon regulatory factor 2
  ENST ID: ENST00000505067
  CDS Start-End: 1-586
aaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagcattgaatttttgttgtgtgtatggtgacttctgtttttgggaaacggaagaagccagcagcatgctgaattgtcctgacaggcctccgctggcctcttgccgagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtac

SEQ ID NO: 143503 - DNA, 498 bp, Homo sapiens
  Payload ID: 8349
  Gene Symbol: IRF2
  Gene Name: interferon regulatory factor 2
  ENST ID: ENST00000506230
  CDS Start-End: 88-498
gattttaggggaagcaggttctgctgctgttgctgctgctactggggctgctgaggctgcgaggaggaggaggaggaggagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaag

SEQ ID NO: 143504 - DNA, 339 bp, Homo sapiens
  Payload ID: 8349
  Gene Symbol: IRF2
  Gene Name: interferon regulatory factor 2
  ENST ID: ENST00000502750
  CDS Start-End: 1-339
cctgatattgaagaagtcaaggataaaagcataaagaaaggaaataatgccttcagggtctaccgaatgctgcccctatcagaacggccttctaagaaagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaat

SEQ ID NO: 143505 - DNA, 568 bp, Homo sapiens
  Payload ID: 8349
  Gene Symbol: IRF2
  Gene Name: interferon regulatory factor 2
  ENST ID: ENST00000510814
  CDS Start-End: 87-568
cagatgcggagaggtggctccatggacacagacctgctgtgtgtgcttctgcgccccaggtgttgtgtgtgggggtgcagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcct

SEQ ID NO: 143506 - DNA, 591 bp, Homo sapiens
  Payload ID: 8349
  Gene Symbol: IRF2
  Gene Name: interferon regulatory factor 2
  ENST ID: ENST00000509274
  CDS Start-End: 65-316
agatgcggagaggtggctccatggacacagacctgctgtgtgtgcttctgcgccccagggcaccatgccggtggaaaggatgcgcatgcgcccgtggctggaggagcagataaactccaacacgatcccggggctcaagtggcttaacaagagacagggtctcactatatggcccacgctggagtgcagtggtgcagtcataactcactgcagcctcgacctcttgggttcaagtgatcctcccacctcagcctccagagtagctggaactacaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagc

SEQ ID NO: 143507 - DNA, 595 bp, Homo sapiens
  Payload ID: 8349
  Gene Symbol: IRF2
  Gene Name: interferon regulatory factor 2
  ENST ID: ENST00000507523
  CDS Start-End: 67-595
gcagatgcggagaggtggctccatggacacagacctgctgtgtgtgcttctgcgccccagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatag

SEQ ID NO: 143508 - DNA, 2564 bp, Homo sapiens
  Payload ID: 8350
  Gene Symbol: IRF2BP1
  Gene Name: interferon regulatory factor 2 binding protein 1
  Uniprot ID: Q8IU81
  ENST ID: ENST00000302165
  CDS Start-End: 397-2151
gtaactttccctgcgaagcggcctctggggcagaagaaggaggtggaggcggcggcggccgttgcagcggcggcggcgagagcggcgggagcccgaggcggcggcgctcgcggcccatcgtggggcccgagctgtgcgcctcggctcggagcccggaccgggcgggggcgccgacgtgcctcagcctgccttcgcgagggaggcgggagtgagcagaaaggcttagggcccagggggcggggaaggggggccgggcctggatccggcggggaggccgagccggaggccggaccgtggctcgcgctgtccccgggacgcggatcgaacgttggcggcgcggatcgcacgtcggcggccggtggaacgcgggagctgggcggcgcgcggactggggccatggcgtctgtgcaggcgtcccgccgccagtggtgctacctgtgcgacctgcccaagatgccgtgggccatggtgtgggacttcagcgaggccgtgtgtcgcggctgcgtgaacttcgagggcgcggaccgcatcgaactgctcatcgatgccgcccgccagctcaagcgcagccacgtgctccccgagggccgctcgcccgggcccccggcccttaagcacccggccaccaaggacctggcggcggcagccgcacaggggccccagctgccgcccccgcaggcccagccccagccgtcagggaccggcggcggcgtgtcgggccaggaccgctatgacagggccacatcatcaggccgcctccccctgccctcgcccgccctggagtacactctggggtcccgcctggccaatgggctgggccgtgaggaggccgtggctgagggggcgcgaagggccttgcttggctccatgcctggcttgatgccccctgggctgctggcagctgcagtgtctggcctgggaagccgaggcctgacgctggcacccggcttgagtcctgcccgtcccctcttcggctccgatttcgagaaagagaagcagcagaggaatgcggactgtctggcagaactgaacgaggccatgcgaggccgggcagaggaatggcacgggcgccccaaagcagtgcgggaacagctactggcgctgtccgcctgcgccccgttcaatgtgcgcttcaagaaggatcacgggctggtggggcgagtgttcgccttcgatgctactgcccgtcctccaggatacgagttcgagctgaagctcttcaccgaatacccctgtggttccggcaatgtgtacgccggcgtcctggcagtggctcgccagatgttccacgatgctctgcgggagccgggcaaggcactggcttcttcgggcttcaagtacctcgaatatgaacgccggcatggatcaggagaatggcggcagctgggcgagctgcttaccgacggcgtccgcagcttccgcgagccagctcccgcggaggccctgccccagcagtacccagagccggcccctgcggctctctgtggcccacccccgcgagccccatcccggaacctggcgcccacgccgcgccgtcgcaaggcatcccccgagccggagggcgaggcggctgggaagatgaccaccgaggagcagcagcaacggcactgggtggcacccggcggcccgtactccgctgagacccctggtgtgccctcgcccattgccgccctgaagaatgtggccgaagccctgggccactcacccaaggaccctggcggaggcggggggcctgtgcgtgcagggggcgccagccctgcagcctcctccacggcccagccgccaacccagcatcgccttgtggcccgcaacggcgaagcagaagtcagtcccacagcgggggccgaagctgtcagcgggggtggcagcggcactggggcgacccctggggcccccctgtgctgtaccctgtgcagggagcggctagaagacacccacttcgtccagtgcccctcggtgcccggacacaagttctgctttccctgctcccgggagttcatcaaggcgcagggcccggccggggaggtgtactgcccgagcggagacaagtgcccgctggtcggctcctccgtgccctgggccttcatgcagggcgagatcgccaccatccttgctggagacatcaaagttaagaaagaacgggacccctaggctaccactgcctccaggctactgccctctgcccctttgccacccaccgctgccgcggataaattattccctccccgacccagcccagtgccacctctatctgtgtacatactcccttcttccacccagatgggtcccctggggtagatgcattgtgggtggggggagaaagcttgtggctcctgtccgagggggtgtttggggtcccttggcccctccagtttccctctgtcctccttggcttggctttgctgctgcttgtagttgggggagaggtgcccccctcctccttgagaagggacctcctgaaaactcgctctttataaacgaggcaaaagcatttaattcccacccccccaccccccgctcccttctgctccttcaataaaccgaaagatgggttttttttttcc

SEQ ID NO: 143509 - DNA, 4663 bp, Homo sapiens
  Payload ID: 8351
  Gene Symbol: IRF2BP2
  Gene Name: interferon regulatory factor 2 binding protein 2
  Uniprot ID: Q7Z5L9
  ENST ID: ENST00000366609
  CDS Start-End: 32-1795
ctcctcctccggcgtcgcgggctcctcggacatggccgcggcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggcctcggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagataccaacattattatattttaaaatcacgctatggaaatatcacctgaattctgtcatttgtcagatttacagtacctttttttctttaacttttagcattaaataaaaataaaattgggagcactgaa

SEQ ID NO: 143510 - DNA, 4615 bp, Homo sapiens
  Payload ID: 8351
  Gene Symbol: IRF2BP2
  Gene Name: interferon regulatory factor 2 binding protein 2
  Uniprot ID: Q7Z5L9
  ENST ID: ENST00000366610
  CDS Start-End: 32-1747
ctcctcctccggcgtcgcgggctcctcggacatggccgcggcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggcctcggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagataccaacattattatattttaaaatcacgctatggaaatatcacctgaattctgtcatttgtcagatttacagtacctttttttctttaacttttagcattaaataaaaataaaattgggagcactgaa

SEQ ID NO: 143511 - DNA, 4157 bp, Homo sapiens
  Payload ID: 8352
  Gene Symbol: IRF2BPL
  Gene Name: interferon regulatory factor 2 binding protein-like
  Uniprot ID: Q9H1B7
  ENST ID: ENST00000238647
  CDS Start-End: 908-3298
gcgagccgcagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgcccgtcggggtcaagacagtggccctgtcggctaaggaagcggcggcggcggcggcagcagcggcggccgccgccgccgccgcgcaacagcaacagcaacagcagcagcagcagcagcaacagcagcagcagcagcagcagcagcagcagcaacaacagctcaaccacgttgatggttccagcaagcctgcggtgctggcggccccgtctggcctggagcgctacggcctaagcgctgccgccgccgccgccgccgccgccgccgctgcggtggaacagcgcagccgcttcgagtacccgccaccgccggtgagcctgggaagcagcagccacaccgcgcgactgcccaacggcctggggggcccaaacggcttccccaaaccaacaccagaggagggacccccagagctgaaccgtcagagccccaattcttcttcagcggcggcgtcggtggcgtctcggcgtggaacgcacggtgggctggttacggggctgcccaacccggggggtggcggaggcccccagctcaccgtgccccccaacctgctaccgcagacgctgcttaacggcccggccagcgctgcggtactccccccaccccctccccacgccctgggcagccgtgggcccccgacgcctgctcccccaggggctcctgggggccccgcttgtctcgggggtaccccgggtgtatcggccacgtcgtcctccgcgtcgtcttcgacctcttcgtcggtggcagaggtgggcgtgggtgctggtggtaagaggcccggctcggtgtcgagcacagaccaggagcgcgagttgaaggagaagcagcgcaacgccgaggccctggccgagctgagcgagagcctgcgcaaccgcgccgaggagtgggccagcaagcccaagatggtccgcgacacgctgctcacgctggcaggctgcacgccctacgaggttcgcttcaagaaggaccactcgctgctgggccgcgttttcgccttcgacgccgtctccaagcccggcatggactacgaattgaagctgttcattgagtaccccacgggctcgggcaacgtgtactccagtgcatctggtgtggccaagcagatgtatcaggactgcatgaaggacttcggccggggcctatcctcgggtttcaagtacctggagtacgaaaagaagcacggctccggggactggcgcctgcttggagacctgctccccgaagccgtgcgcttcttcaaggagggcgtgcccggcgccgacatgctgccccagccctacctggacgccagctgtcccatgctgcccactgctctggtgagtctgagccgcgcccccagcgcacccccggggaccggggccttgccgcccgccgcgccgtcgggccggggcgcagccgccagcctgcgcaagagaaaggcctctccggagcccccggactcagccgagggcgcgctgaagctgggcgaggaacagcagaggcagcagtggatggcgaaccagagcgaggcgctgaagctcaccatgtccgccgggggcttcgcggcgccggggcacgcggcggggggtccgcctccgccgcccccacctctgggaccccattccaaccggaccaccccacctgagtcagccccccagaacggtccgtcccctatggccgctctcatgtcggtggcagatactctgggcacagcgcactcgcccaaggatggcagttccgtgcactctaccactgcgtcggcgcggcgaaacagcagcagcccagtctcgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttttgccaaggccagtgttgctgcctaaaaaaaaaaaaaaaaaaaaaaaaaaaaaaaaaaaatgctataaaatggtgaaagcttccttctaaactgccccaagtgttgaagtcttcactttattttgttgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatattaa

SEQ ID NO: 143512 - DNA, 1691 bp, Homo sapiens
  Payload ID: 8353
  Gene Symbol: IRF3
  Gene Name: interferon regulatory factor 3
  Uniprot ID: Q14653
  ENST ID: ENST00000309877
  CDS Start-End: 332-1615
gctaccctgaaagtggggatacttactttcgatgatgtgggggagggaggaggtctatactggcggaattgagggagtggagggtctgcactgaagacgctggggaaggatgtgccatggatatgggaaggaaccctagctgattagagagcctctcgggaggatgggaggatgggaagaggaggtttcctgtttgtacccccgaaaatatgggtgaaggacctgtgccgtggcccgtgagaaggaggtctgggtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 143513 - DNA, 1442 bp, Homo sapiens
  Payload ID: 8353
  Gene Symbol: IRF3
  Gene Name: interferon regulatory factor 3
  ENST ID: ENST00000377135
  CDS Start-End: 519-1364
ggaaacccaaaaaagggcataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatgatc

SEQ ID NO: 143514 - DNA, 1613 bp, Homo sapiens
  Payload ID: 8353
  Gene Symbol: IRF3
  Gene Name: interferon regulatory factor 3
  Uniprot ID: Q14653
  ENST ID: ENST00000377139
  CDS Start-End: 254-1537
ggaaacccaaaaaagggcataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 143515 - DNA, 315 bp, Homo sapiens
  Payload ID: 8353
  Gene Symbol: IRF3
  Gene Name: interferon regulatory factor 3
  Uniprot ID: Q14653
  ENST ID: ENST00000442265
  CDS Start-End: 1-315
atgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggagttggggacttttcccagccagacacctctccggacaccaatggtggaggcagtacttctgatacccaggaagacattctggatgagttactgggtaacatggtgttggccccactcccagatccgggacccccaagcctggctgtag

SEQ ID NO: 143516 - DNA, 823 bp, Homo sapiens
  Payload ID: 8353
  Gene Symbol: IRF3
  Gene Name: interferon regulatory factor 3
  ENST ID: ENST00000596822
  CDS Start-End: 399-806
agccccagcgctctagagctcagctgacgggaaagggggtgcgcagcctcgagtttgagagctacccggagctccaagacaggggtgggttccagctgcccgcacgccccgaccttccatcgtaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 143517 - DNA, 739 bp, Homo sapiens
  Payload ID: 8353
  Gene Symbol: IRF3
  Gene Name: interferon regulatory factor 3
  ENST ID: ENST00000595034
  CDS Start-End: 381-739
ttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtgcgtgcgacgacctgggacgctggaaacccggagctgcgcgctgggcggaaaggactcctagtgggcccggctgagaaggcggaggtggcgcgcgaggggcgggctcgtgccaacgctggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgag

SEQ ID NO: 143518 - DNA, 1741 bp, Homo sapiens
  Payload ID: 8353
  Gene Symbol: IRF3
  Gene Name: interferon regulatory factor 3
  Uniprot ID: Q14653
  ENST ID: ENST00000597198
  CDS Start-End: 383-1666
ataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatg

SEQ ID NO: 143519 - DNA, 1117 bp, Homo sapiens
  Payload ID: 8353
  Gene Symbol: IRF3
  Gene Name: interferon regulatory factor 3
  ENST ID: ENST00000599144
  CDS Start-End: 203-1048
tgacgggaaagggggtgcgcagcctcgagtttgagagctacccggagctccaagacaggggtgggttccagctgcccgcacgccccgaccttccatcgtaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 143520 - DNA, 768 bp, Homo sapiens
  Payload ID: 8353
  Gene Symbol: IRF3
  Gene Name: interferon regulatory factor 3
  ENST ID: ENST00000601809
  CDS Start-End: 197-768
gcataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaaccc

SEQ ID NO: 143521 - DNA, 1637 bp, Homo sapiens
  Payload ID: 8353
  Gene Symbol: IRF3
  Gene Name: interferon regulatory factor 3
  ENST ID: ENST00000600911
  CDS Start-End: 394-1620
tgcaggaggtagaggcttacacgtgaatcgattctgcactgaaataactagggaaagaggatgctaccctgaaagtggggatacttactttcgatgatgtgggggagggaggaggtctatactggcggaattgagggagtggagggtctgcactgaagacgctggggaaggatgtgccatggatatgggaaggaaccctagctgattagagagcctctcgggaggatgggaggatgggaagaggaggtttcctgtttgtacccccgaaaatatgggtgaaggacctgtgccgtggcccgtgagaaggaggtctgggtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 143522 - DNA, 2874 bp, Homo sapiens
  Payload ID: 8353
  Gene Symbol: IRF3
  Gene Name: interferon regulatory factor 3
  ENST ID: ENST00000597636
  CDS Start-End: 1020-2009
ataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaactagaaaaagtagggaggaaagaggaaaagaggaggcgtctacactgagggggttctagagagggaggggtggactccgtagatgggggtagttcagtctcgaaacctggggcgtgctctgtcctggaggagggaggcgggcagtcggaggggaattgaatggaagttctgtgttggaaatgttttgggagatcttctgtagggggactgtggaagggggtctacattggggtaagtgcaggaggtagaggcttacacgtgaatcgattctgcactgaaataactagggaaagaggatgctaccctgaaagtggggatacttactttcgatgatgtgggggagggaggaggtctatactggcggaattgagggagtggagggtctgcactgaagacgctggggaaggatgtgccatggatatgggaaggaaccctagctgattagagagcctctcgggaggatgggaggatgggaagaggaggtttcctgtttgtacccccgaaaatatgggtgaaggacctgtgccgtggcccgtgagaaggaggtctgggtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtgagacaggggcttcgacctggccagtacaaagcagcctgcacagtggttaacaactcaggattggccgggcacggtggctcacgcctgtagtcccagcactttgggaggctgaggtgggcagatgacaagttcaggagttcgagaccagcctggtcaacatagtgaaaccccatctctactaaagatacaaaaaaatagtcgggcgtggtggcacgtgcctgtaatcccagctactcgggaggctgaggcaggagaattgcttgaacccaggaggcggagattgcagtgagctgagatcgcaccactgcactctagcctggtgacagagtaagactccatctcgaacaacaaaaaaaaaagaactcatgattaggactgaattcagacgctggctgcccttggcccgctgtataaccgaggcaaaggactttgccctgagcccgtggaatccaaggatggtctcctctctctacctgcctgccagcgctgggatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgcta

SEQ ID NO: 143523 - DNA, 710 bp, Homo sapiens
  Payload ID: 8353
  Gene Symbol: IRF3
  Gene Name: interferon regulatory factor 3
  Uniprot ID: Q14653
  ENST ID: ENST00000596765
  CDS Start-End: 177-641
gagtttgagagctacccggagctccaagacaggggtgggttccagctgcccgcacgccccgaccttccatcgtaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 143524 - DNA, 700 bp, Homo sapiens
  Payload ID: 8353
  Gene Symbol: IRF3
  Gene Name: interferon regulatory factor 3
  ENST ID: ENST00000600453
  CDS Start-End: 394-700
agcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaactagaaaaagccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacc

SEQ ID NO: 143525 - DNA, 1055 bp, Homo sapiens
  Payload ID: 8353
  Gene Symbol: IRF3
  Gene Name: interferon regulatory factor 3
  Uniprot ID: Q14653
  ENST ID: ENST00000599223
  CDS Start-End: 84-986
gagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 143526 - DNA, 680 bp, Homo sapiens
  Payload ID: 8353
  Gene Symbol: IRF3
  Gene Name: interferon regulatory factor 3
  ENST ID: ENST00000601373
  CDS Start-End: 428-680
ttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggt

SEQ ID NO: 143527 - DNA, 924 bp, Homo sapiens
  Payload ID: 8353
  Gene Symbol: IRF3
  Gene Name: interferon regulatory factor 3
  ENST ID: ENST00000593818
  CDS Start-End: 608-924
gaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtgcgtgcgacgacctgggacgctggaaacccggagctgcgcgctgggcggaaaggactcctagtgggcccggctgagaaggcggaggtggcgcgcgaggggcgggctcgtgccaacgctggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccct

SEQ ID NO: 143528 - DNA, 1556 bp, Homo sapiens
  Payload ID: 8353
  Gene Symbol: IRF3
  Gene Name: interferon regulatory factor 3
  Uniprot ID: Q14653
  ENST ID: ENST00000601291
  CDS Start-End: 181-1539
aaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggctcctgggcccccagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcctgctatga

SEQ ID NO: 143529 - DNA, 1118 bp, Homo sapiens
  Payload ID: 8353
  Gene Symbol: IRF3
  Gene Name: interferon regulatory factor 3
  ENST ID: ENST00000598108
  CDS Start-End: 258-1118
tttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgacctgtgccgtggcccgtgagaaggaggtctgggtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctgggg

SEQ ID NO: 143530 - DNA, 1468 bp, Homo sapiens
  Payload ID: 8353
  Gene Symbol: IRF3
  Gene Name: interferon regulatory factor 3
  ENST ID: ENST00000598808
  CDS Start-End: 607-1452
gcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtgcgtgcgacgacctgggacgctggaaacccggagctgcgcgctgggcggaaaggactcctagtgggcccggctgagaaggcggaggtggcgcgcgaggggcgggctcgtgccaacgctggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatg

SEQ ID NO: 143531 - DNA, 1494 bp, Homo sapiens
  Payload ID: 8353
  Gene Symbol: IRF3
  Gene Name: interferon regulatory factor 3
  ENST ID: ENST00000593922
  CDS Start-End: 580-1425
gagtttgagagctacccggagctccaagacaggggtgggttccagctgcccgcacgccccgaccttccatcgtaggtgcgtgcgacgacctgggacgctggaaacccggagctgcgcgctgggcggaaaggactcctagtgggcccggctgagaaggcggaggtggcgcgcgaggggcgggctcgtgccaacgctggtgggtggggctagaacgggaggggcggggctagccggatccgctgactgatggtggggcgcaagcagggttggagctgcagggttacgggaataaaaccgggaaagccggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 143532 - DNA, 882 bp, Homo sapiens
  Payload ID: 8353
  Gene Symbol: IRF3
  Gene Name: interferon regulatory factor 3
  Uniprot ID: Q14653
  ENST ID: ENST00000600022
  CDS Start-End: 349-813
gagtttgagagctacccggagctccaagacaggggtgggttccagctgcccgcacgccccgaccttccatcgtaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagctgagccctcgctcctcatggtgtgcctccaacccccctgttccccaccacctcaaccaataaactggttcct

SEQ ID NO: 143533 - DNA, 931 bp, Homo sapiens
  Payload ID: 8353
  Gene Symbol: IRF3
  Gene Name: interferon regulatory factor 3
  ENST ID: ENST00000596756
  CDS Start-End: 139-931
gggagagcgttggtggcgtccgagagcgaggagcgggaaagaggatgggtctgcacggagagtggaaaggcaggctgtgtactctggggaaagtggagcaaggaaggagctacagtggccgacgctggaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtgg

SEQ ID NO: 143534 - DNA, 633 bp, Homo sapiens
  Payload ID: 8353
  Gene Symbol: IRF3
  Gene Name: interferon regulatory factor 3
  ENST ID: ENST00000593337
  CDS Start-End: 173-633
gggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactggagtgggagttcgaggtgacagccttcta

SEQ ID NO: 143535 - DNA, 447 bp, Homo sapiens
  Payload ID: 8353
  Gene Symbol: IRF3
  Gene Name: interferon regulatory factor 3
  ENST ID: ENST00000596788
  CDS Start-End: 1-215
agcacggcctacggcaggatgcacagcaggaggatttcggaatcttccaggtgcgtgcgacgacctgggacgctggaaacccggagctgcgcgctgggcggaaaggactcctagtgggcccggctgagaaggcggaggtggcgcgcgaggggcgggctcgtgccaacgctggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatg

SEQ ID NO: 143536 - DNA, 5331 bp, Homo sapiens
  Payload ID: 8354
  Gene Symbol: IRF4
  Gene Name: interferon regulatory factor 4
  Uniprot ID: Q15306
  ENST ID: ENST00000380956
  CDS Start-End: 127-1482
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttatgga

SEQ ID NO: 143537 - DNA, 1607 bp, Homo sapiens
  Payload ID: 8354
  Gene Symbol: IRF4
  Gene Name: interferon regulatory factor 4
  ENST ID: ENST00000493114
  CDS Start-End: 98-1330
cttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtacttaggagtttagcttaagtcgtcatatataaaatacagtctctaatatcatgattgatggagagcattcagcttgccttagatgctgtaaattcaggaaaagctgaacattaaggcgtttttgttttttggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggt

SEQ ID NO: 143538 - DNA, 2749 bp, Homo sapiens
  Payload ID: 8355
  Gene Symbol: IRF5
  Gene Name: interferon regulatory factor 5
  Uniprot ID: Q13568
  ENST ID: ENST00000249375
  CDS Start-End: 41-1537
gtccagctgcgcctggaaagcgagctcggacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgt

SEQ ID NO: 143539 - DNA, 1680 bp, Homo sapiens
  Payload ID: 8355
  Gene Symbol: IRF5
  Gene Name: interferon regulatory factor 5
  Uniprot ID: Q13568
  ENST ID: ENST00000357234
  CDS Start-End: 122-1666
gcccggcaggttggcggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacg

SEQ ID NO: 143540 - DNA, 2786 bp, Homo sapiens
  Payload ID: 8355
  Gene Symbol: IRF5
  Gene Name: interferon regulatory factor 5
  Uniprot ID: Q13568
  ENST ID: ENST00000402030
  CDS Start-End: 73-1569
gcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgtataaa

SEQ ID NO: 143541 - DNA, 560 bp, Homo sapiens
  Payload ID: 8355
  Gene Symbol: IRF5
  Gene Name: interferon regulatory factor 5
  ENST ID: ENST00000467002
  CDS Start-End: 383-560
attaaacagccgtgttgggcagggccagactgctggactgacagtagggggcaggcagccggaccctctgagctccccaacggcaccagcgcctgcacggcctcagcccagggggtcattagggaagctctccccgattctgtgcagacagagcttcctctgtccacccttgctcggccagaattgtgtgccgctggtgactggcacccctctattctagggccaaggcctctcaggggtctacagatacaactatggccttcctaacaggctccggcaggcgttagggccttcctaagtgctacccgaatgcgtgtccagtgggaggagaagggggaggaccaagaacctagatgaatggccctagagagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggag

SEQ ID NO: 143542 - DNA, 637 bp, Homo sapiens
  Payload ID: 8355
  Gene Symbol: IRF5
  Gene Name: interferon regulatory factor 5
  ENST ID: ENST00000479582
  CDS Start-End: 213-637
cgggaggcgcagcctgggcagagctcagcttggtcccgccgcccggccggtgctccctggcgcagccacgcaggcgcaccgcagacagccttcctaacaggctccggcaggcgttagggccttcctaagtgctacccgaatgcgtgtccagtgggaggagaagggggaggaccaagaacctagatgaatggccctagagagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggaga

SEQ ID NO: 143543 - DNA, 689 bp, Homo sapiens
  Payload ID: 8355
  Gene Symbol: IRF5
  Gene Name: interferon regulatory factor 5
  ENST ID: ENST00000489702
  CDS Start-End: 235-689
ctcatttgtgtgcagccccggaggaccagagtggggaagcaccccaccctctcccagggcccaactgagcactgcagcgggaggtacggggttgtcaaatgacagttttgccattccagattgccaaaagagccagtggccagtctagggcaccgcgccgtctggcatctccctggaggccctgggcctggcccgaggctcagcccggatctgcagttgccagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagaggtgagtgt

SEQ ID NO: 143544 - DNA, 2088 bp, Homo sapiens
  Payload ID: 8355
  Gene Symbol: IRF5
  Gene Name: interferon regulatory factor 5
  Uniprot ID: Q13568
  ENST ID: ENST00000465603
  CDS Start-End: 50-493
agctcagaggcggcactaggcaggtgcaaccccaaaagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacaga

SEQ ID NO: 143545 - DNA, 553 bp, Homo sapiens
  Payload ID: 8355
  Gene Symbol: IRF5
  Gene Name: interferon regulatory factor 5
  ENST ID: ENST00000464557
  CDS Start-End: 236-553
agcctgggcagagctcagcttggtcccgccgcccggccggtgctccctggcgcagccacgcaggcgcaccgcagacagccttcctaacaggctccggcaggcgttagggccttcctaagtgctacccgaatgcgtgtccagtgggaggagaagggggaggaccaagaacctagatgaatggccctagagaggtaacatctgtttggtgcctgctgtcattggagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacggg

SEQ ID NO: 143546 - DNA, 2282 bp, Homo sapiens
  Payload ID: 8355
  Gene Symbol: IRF5
  Gene Name: interferon regulatory factor 5
  Uniprot ID: Q13568
  ENST ID: ENST00000473745
  CDS Start-End: 216-1712
agaaagcggaactgagcccgcgtgttctgaggccagggcagggctggagcgttctgaacacctccccgtcccagcccctgggccaggcaagggccggccttacctctcctgggttggtggcagcagagctgggctctgagggaggcctgcaatgtgagacagtagcagctcagaggcggcactaggcaggtgcaaccccaaaagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacaga

SEQ ID NO: 143547 - DNA, 1374 bp, Homo sapiens
  Payload ID: 8355
  Gene Symbol: IRF5
  Gene Name: interferon regulatory factor 5
  Uniprot ID: Q13568
  ENST ID: ENST00000477535
  CDS Start-End: 122-1360
gcccggcaggttggcggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagtgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacg

SEQ ID NO: 143548 - DNA, 587 bp, Homo sapiens
  Payload ID: 8355
  Gene Symbol: IRF5
  Gene Name: interferon regulatory factor 5
  ENST ID: ENST00000473787
  CDS Start-End: 71-385
ttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaagggtctcactctgtcacccaggctggagtgcagtggcttgatctcagctcactgcagcctcgacctcccaggctcaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagag

SEQ ID NO: 143549 - DNA, 595 bp, Homo sapiens
  Payload ID: 8355
  Gene Symbol: IRF5
  Gene Name: interferon regulatory factor 5
  ENST ID: ENST00000613821
  CDS Start-End: 122-595
gcccggcaggttggcggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagatgcagtgcagtctggcccccacatga

SEQ ID NO: 143550 - DNA, 1652 bp, Homo sapiens
  Payload ID: 8355
  Gene Symbol: IRF5
  Gene Name: interferon regulatory factor 5
  Uniprot ID: Q13568
  ENST ID: ENST00000619830
  CDS Start-End: 50-493
agctcagaggcggcactaggcaggtgcaaccccaaaagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgagactcccagccccctgaggattactcttttggtgcaggagaggaggaggaagaagaggaagagctgcagaggatgttgccaagcctgagcctcacagaggatgtcaagtggccgcccactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccc

SEQ ID NO: 143551 - DNA, 4306 bp, Homo sapiens
  Payload ID: 8356
  Gene Symbol: IRF6
  Gene Name: interferon regulatory factor 6
  Uniprot ID: O14896
  ENST ID: ENST00000367021
  CDS Start-End: 174-1577
cttggctaagacgtcgaggagcgtggtagcgacgggtgatcttcgctgcggacttggttcggagggacgtccgcttctggtggacagattgagcaaagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctacgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaa

SEQ ID NO: 143552 - DNA, 1027 bp, Homo sapiens
  Payload ID: 8356
  Gene Symbol: IRF6
  Gene Name: interferon regulatory factor 6
  ENST ID: ENST00000456314
  CDS Start-End: 199-1027
ctttaccagactcagtagtggagacgtgttctcagcctttgtcgccagtgttcccaagccttctcccagacactggattgttgtatggatagccagctgagacccctccttttctccatacagaatctttgagcggtcaagggaaagacaagccgactcttcagatccctgtggacacactgcctgctcttccatatcatggccctccacccccgcagagtccggctaaagccctggctggtggcccaggtggatagtggcctctaccctgggctcatctggctacacagggactctaaacgcttccagattccctggaaacatgccacccggcatagccctcaacaagaagaggaaaataccatttttaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcc

SEQ ID NO: 143553 - DNA, 4256 bp, Homo sapiens
  Payload ID: 8356
  Gene Symbol: IRF6
  Gene Name: interferon regulatory factor 6
  Uniprot ID: O14896
  ENST ID: ENST00000542854
  CDS Start-End: 341-1459
ggatgcgaaggctgcggcgtcctggggcgaggcgctgacgtgagctcggcgcacctgggctgggcaggtaagggctggtgcgggacggggagaggaacctgcagtccctacttgggtagagccaggcgccccttggctaagacgtcgaggagcgtggtagcgacgggtgatcttcgctgcggacttggttcggagggacgtccgcttctggtggacagattgagcaaaggcctgggctgtagagacagggaagtaccaggaaggggtggatgaccctgacccagctaaatggaaggcccagctgcgctgtgctctcaataagagcagagaattcaacctgatgtatgatggcaccaaggaggtgcccatgaacccagtgaagatatatcaagtgtgtgacatccctcagccccagggctcgatcattaacccaggatccacagggtctgctccctgggatgagaaggataatgatgtggatgaagaagatgaggaagatgagctggatcagtcgcagcaccatgttcccatccaggacaccttccccttcctgaacatcaatggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctcccaatgactgacctggacatcaagtttcagtaccgtgggaaggagtacgggcagaccatgaccgtgagcaaccctcagggctgccgactcttctatggggacctgggtcccatgcctgaccaggaggagctctttggtcccgtcagcctggagcaggtcaaattcccaggtcctgagcatattaccaatgagaagcagaagctgttcactagcaagctgctggacgtcatggacagaggactgatcctggaggtcagcggtcatgccatttatgccatcaggctgtgccagtgcaaggtgtactggtctgggccatgtgccccatcacttgttgctcccaacctgattgagagacaaaagaaggtcaagctattttgtctggaaacattccttagcgatctcattgcccaccagaaaggacagatagagaagcagccaccgtttgagatctacttatgctttggggaagaatggccagatgggaaaccattggaaaggaaactcatcttggttcaggtcattccagtagtggctcggatgatctacgagatgttttctggtgatttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttccttctcttttttataatattgtacatatggatttttttattgtttagatttaaccagcttttaaatctctcttttctctaacagtgttagaagtttgtgattctccaaatatgcctagatttaaagctgatttaatttatggaaaaatcacccttcagactttgcttttctttttcaaatctcctaatggtagtatgatatagcatagtagaaggagatttggcctgggagtttggacaccaaagttctagctgcagctttgcttccaatgtgaccttgaacaagtcctttaacctctgggcttcagatttattgcttataaagtgaagagattggagtagtgcctgaaattgcatccagctttagaacggactcaatgaccttcttctacttgtacaaggctaaactgcctggaacagaatccttctgcattgttcttgtaccacatttttccttggttttgttaaagtttcctcaagcactgatttgtccaggatcgagctctgtttgacctgttctgctagtatagtaagctggctccctgatgggggaagtgagagggagaggagctggctggctggttgcttagaaactatgcttgatatctaaatagaaatgggtgccaaagtctgaaagtcacccagcctgtggagtgaaagctcacaaatttggcttctaaagggaagctgttgacacagaaagcctagggattctgtggaagaataggttgtcaggcatttaccttattaccactcaaataccagtgtgtgtgtgttgggggggcggcagggagagggggtaggtgacagtatgtgactcaggtgttagctttaagaggaaagagctctatttttcttgttttcttctctgagctagactgagctggggatctaagatgtacttctctgactacaaaagggacagtatcatttagattttttgcagttggaagaaatgggttgttgagtgtgttaaggctgggatgaagaagggctgggcagtactcttctggaaaggctcacctagcacgaacctgcttgtctcccttactagtggaggtatctgagtgtgaacagtgaaggtaaagagtggtatagaacaatgcagctgtatctgtcacaaactggtcttatctagaaacatctgctgagtctctaaccctttcagctttctcttcttttttgagacagagtcttgctttgttgcccaggctggagtgcagtggcaagtcaccacttactgcagctttaagctcctgggctcaagcaatcgtcctgccccagcctcctgagtagttgggacaacagtcgtgcactatgatgcttggctaattttttttttatttttgtagagatgaggtcttgctatgttgcccaggctggtcttgaactcctgggctcaagcaatctgggacctaaatggcaaataagatgctaatctgtggttgcaagccccagtcctcttgaatagtgatgcctatctgtctgtgtcgggacatagtaaggaagcccatgtctagtctggtacctttaaaccaggccatctccaacttttcaaaatgactcaaaagttgagctagccttattttaaaaactaaaagttcaaaatcagtggtgacatgaggacttatttatttaaagtgcttaagccttggttttagagtttctaagagacctagtggaatttgctattatgaaaagcatgaaaagattaagaaacctggctaaaggtcaggtgcccagcttcgaggaaaagttgggcttttagggaccgggaagcattaaaggcacagaaactttacattttgggggtcattttgttgagtaggtgaagtgagggatttgggcttgatatttggctgccccatctctacgtgggaactcaaagttaaaaacccactgtaggtaaattagaagggcagctcttgaatctgggccagtctatatcccttctgtgaagtgctaacagccaggctatctgtagcctgggtgggagcccagataatgtgagctggtaaagggtattggaaaagtgccaagaaatgccaagcttttggttcgtaaccactataaaaagtttatgaacatgtcagaggaatggatgagtgatttgtgaggtcttaactagataccccggtttcttccttgttttggcttcttttcagaatgccgggagagtacatgcagggattccatctaatcaccctcagcactctttctctggtcctgctggatagatttagatttcctttctttttttagggcctcagtctgctatctcctttggtggctaccaccactcactcccttgatatcttctactcccttgccttcaccttgcttaagactgagaagggagttagattttgtcactagctcttctttttcctcactgtgtaccccaccaaacaagattagttcaagttaaaaagaacctactggaggtaaactgggagagcaagtgttggatctgggctggtccctttcccataaaattaggtccctggttgtatgttcccatagcaccccatacttcctctctcagaataatcatttcccttgtaatgctcagcatccgcatcctgcttgactgcaaacttgctgaaggtagggactgtttgtcttggacttcgctgccagtccttagaacagtgtctgggacacagtgtgttctcaaatatttgttgctggaataaatgaatgaactaaatcagtcttttagggatttactgttaaccaccatgggaaaattaaataaatgcggggaaggaaaacgtt

SEQ ID NO: 143554 - DNA, 1992 bp, Homo sapiens
  Payload ID: 8357
  Gene Symbol: IRF7
  Gene Name: interferon regulatory factor 7
  Uniprot ID: Q92985
  ENST ID: ENST00000330243
  CDS Start-End: 388-1938
ccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggcc

SEQ ID NO: 143555 - DNA, 1801 bp, Homo sapiens
  Payload ID: 8357
  Gene Symbol: IRF7
  Gene Name: interferon regulatory factor 7
  Uniprot ID: Q92985
  ENST ID: ENST00000348655
  CDS Start-End: 287-1711
cagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 143556 - DNA, 2051 bp, Homo sapiens
  Payload ID: 8357
  Gene Symbol: IRF7
  Gene Name: interferon regulatory factor 7
  Uniprot ID: Q92985
  ENST ID: ENST00000397566
  CDS Start-End: 411-1961
agggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 143557 - DNA, 1943 bp, Homo sapiens
  Payload ID: 8357
  Gene Symbol: IRF7
  Gene Name: interferon regulatory factor 7
  ENST ID: ENST00000397570
  CDS Start-End: 411-1874
agggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtct

SEQ ID NO: 143558 - DNA, 1968 bp, Homo sapiens
  Payload ID: 8357
  Gene Symbol: IRF7
  Gene Name: interferon regulatory factor 7
  Uniprot ID: Q92985
  ENST ID: ENST00000397574
  CDS Start-End: 371-1882
gaaactcccgcctggccaccataaaagcgccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccag

SEQ ID NO: 143559 - DNA, 1019 bp, Homo sapiens
  Payload ID: 8357
  Gene Symbol: IRF7
  Gene Name: interferon regulatory factor 7
  ENST ID: ENST00000532788
  CDS Start-End: 397-930
ataaaagcgccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggcgaggccgcggccccagagtccccgcaccaggcagagccgtac

SEQ ID NO: 143560 - DNA, 1776 bp, Homo sapiens
  Payload ID: 8357
  Gene Symbol: IRF7
  Gene Name: interferon regulatory factor 7
  Uniprot ID: Q92985
  ENST ID: ENST00000533182
  CDS Start-End: 322-816
gagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactcc

SEQ ID NO: 143561 - DNA, 1588 bp, Homo sapiens
  Payload ID: 8357
  Gene Symbol: IRF7
  Gene Name: interferon regulatory factor 7
  ENST ID: ENST00000525445
  CDS Start-End: 303-1496
ccaggcctggacactggttcaacacctggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacg

SEQ ID NO: 143562 - DNA, 806 bp, Homo sapiens
  Payload ID: 8357
  Gene Symbol: IRF7
  Gene Name: interferon regulatory factor 7
  ENST ID: ENST00000533190
  CDS Start-End: 310-717
cccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgaggtgagcgacgccgg

SEQ ID NO: 143563 - DNA, 1634 bp, Homo sapiens
  Payload ID: 8357
  Gene Symbol: IRF7
  Gene Name: interferon regulatory factor 7
  Uniprot ID: Q92985
  ENST ID: ENST00000469048
  CDS Start-End: 287-781
cagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgc

SEQ ID NO: 143564 - DNA, 1604 bp, Homo sapiens
  Payload ID: 8357
  Gene Symbol: IRF7
  Gene Name: interferon regulatory factor 7
  ENST ID: ENST00000532326
  CDS Start-End: 355-912
caccataaaagcgccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgggataactcgggggacccggccgacccgcacaaggtgtacgcgctcagccgggagctgtgctggcgaggcccaggcacggaccagactgaggcagaggcccccgcagctgtcccaccaccacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggcc

SEQ ID NO: 143565 - DNA, 1943 bp, Homo sapiens
  Payload ID: 8357
  Gene Symbol: IRF7
  Gene Name: interferon regulatory factor 7
  ENST ID: ENST00000617397
  CDS Start-End: 411-1874
agggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtct

SEQ ID NO: 143566 - DNA, 2051 bp, Homo sapiens
  Payload ID: 8357
  Gene Symbol: IRF7
  Gene Name: interferon regulatory factor 7
  Uniprot ID: Q92985
  ENST ID: ENST00000612534
  CDS Start-End: 411-1961
agggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 143567 - DNA, 1968 bp, Homo sapiens
  Payload ID: 8357
  Gene Symbol: IRF7
  Gene Name: interferon regulatory factor 7
  Uniprot ID: Q92985
  ENST ID: ENST00000621391
  CDS Start-End: 371-1882
gaaactcccgcctggccaccataaaagcgccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccag

SEQ ID NO: 143568 - DNA, 1604 bp, Homo sapiens
  Payload ID: 8357
  Gene Symbol: IRF7
  Gene Name: interferon regulatory factor 7
  ENST ID: ENST00000632194
  CDS Start-End: 355-912
caccataaaagcgccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggcccaggcacggaccagactgaggcagaggcccccgcagctgtcccaccaccacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggcc

SEQ ID NO: 143569 - DNA, 1992 bp, Homo sapiens
  Payload ID: 8357
  Gene Symbol: IRF7
  Gene Name: interferon regulatory factor 7
  Uniprot ID: Q92985
  ENST ID: ENST00000632827
  CDS Start-End: 388-1938
ccggccctccgcttccccgcgagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggcc

SEQ ID NO: 143570 - DNA, 1588 bp, Homo sapiens
  Payload ID: 8357
  Gene Symbol: IRF7
  Gene Name: interferon regulatory factor 7
  ENST ID: ENST00000631879
  CDS Start-End: 303-1496
ccaggcctggacactggttcaacacctggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacg

SEQ ID NO: 143571 - DNA, 1634 bp, Homo sapiens
  Payload ID: 8357
  Gene Symbol: IRF7
  Gene Name: interferon regulatory factor 7
  Uniprot ID: Q92985
  ENST ID: ENST00000634105
  CDS Start-End: 287-781
cagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgc

SEQ ID NO: 143572 - DNA, 1776 bp, Homo sapiens
  Payload ID: 8357
  Gene Symbol: IRF7
  Gene Name: interferon regulatory factor 7
  Uniprot ID: Q92985
  ENST ID: ENST00000633274
  CDS Start-End: 322-816
gagacgaaacttcccgtcccggcggctctggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactcc

SEQ ID NO: 143573 - DNA, 1801 bp, Homo sapiens
  Payload ID: 8357
  Gene Symbol: IRF7
  Gene Name: interferon regulatory factor 7
  Uniprot ID: Q92985
  ENST ID: ENST00000633943
  CDS Start-End: 287-1711
cagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 143574 - DNA, 3030 bp, Homo sapiens
  Payload ID: 8358
  Gene Symbol: IRF8
  Gene Name: interferon regulatory factor 8
  Uniprot ID: Q02556
  ENST ID: ENST00000268638
  CDS Start-End: 423-1703
agtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggccgcgcgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccaatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaagct

SEQ ID NO: 143575 - DNA, 1582 bp, Homo sapiens
  Payload ID: 8358
  Gene Symbol: IRF8
  Gene Name: interferon regulatory factor 8
  ENST ID: ENST00000566369
  CDS Start-End: 1-458
aggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccaatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttccc

SEQ ID NO: 143576 - DNA, 946 bp, Homo sapiens
  Payload ID: 8358
  Gene Symbol: IRF8
  Gene Name: interferon regulatory factor 8
  ENST ID: ENST00000562492
  CDS Start-End: 189-857
agaggtccctggaaaggcacctctgtctgtgctgcaggaacaccatccggaaagctagcttgcacccccaggctctcccccagagataagccctgggtggtgggtatgcagtccagtggtattctgggggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatcc

SEQ ID NO: 143577 - DNA, 289 bp, Homo sapiens
  Payload ID: 8358
  Gene Symbol: IRF8
  Gene Name: interferon regulatory factor 8
  ENST ID: ENST00000569145
  CDS Start-End: 247-289
tgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggcgtgccgctggtgacggggtacaccacctacgacgcgcaccattcagcattctcccagatggtgatcagcttctactatgggggcaagctggtgggccaggccaccaccacctgccccga

SEQ ID NO: 143578 - DNA, 531 bp, Homo sapiens
  Payload ID: 8358
  Gene Symbol: IRF8
  Gene Name: interferon regulatory factor 8
  ENST ID: ENST00000564617
  CDS Start-End: 55-531
tttgcactcagggctgtgaggtcatggaggccagcattgccttctcatggcaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatc

SEQ ID NO: 143579 - DNA, 522 bp, Homo sapiens
  Payload ID: 8358
  Gene Symbol: IRF8
  Gene Name: interferon regulatory factor 8
  ENST ID: ENST00000565552
  CDS Start-End: 382-522
cctggagcgcggcagcaagcgtgggaacgcgggcggcgagacggcggcaggacggcggcaggaggctcaggaactgtggattctagtttaagaaacttgtagcaaggaaatcaggggagttgaaagtctcagaagccaacccctatgttgtgttctggccacctctgtgcagctcattcctcaatctaggagaaatttttctaccttgccccaggaaagagctgctaacttgttttcggggagtgtgggggggtctttggtattggtgttccatttctcttctcaggtaccctctcccaagtctgtcccttctttatgataaacacagtggcctgctttagaattctgggtctcttgagatacagcctctcaacttacaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagat

SEQ ID NO: 143580 - DNA, 880 bp, Homo sapiens
  Payload ID: 8358
  Gene Symbol: IRF8
  Gene Name: interferon regulatory factor 8
  ENST ID: ENST00000569607
  CDS Start-End: 220-880
tggggaaaagcactgaattcagcggaagcctgtgctccctggagcctctggcacgccatgtgcagccttttaagggacttttggagaaggagcgattggggttactccctgtacaccacacctgggtggctctgagcttgcttttctgtttctcctgcaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatca

SEQ ID NO: 143581 - DNA, 1038 bp, Homo sapiens
  Payload ID: 8358
  Gene Symbol: IRF8
  Gene Name: interferon regulatory factor 8
  ENST ID: ENST00000564803
  CDS Start-End: 54-1038
atggaggccagcattgccttctcatggcaggtgtcccggagtccctgaatctgatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttcc

SEQ ID NO: 143582 - DNA, 1394 bp, Homo sapiens
  Payload ID: 8358
  Gene Symbol: IRF8
  Gene Name: interferon regulatory factor 8
  ENST ID: ENST00000563180
  CDS Start-End: 328-708
tgttcactgtggttgtatctgcctgaaaggaaagggcagatgaaagctggaaggagcacagccagcacagtgggaggggcctgcagggggctgctggtggctgcaggtttcccacggagctttcagtttgcactcagggctgtgaggtcatggaggccagcattgccttctcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgtaactatcctttatgggcatgaaaccttccagaagctgccctggcctgtagccttcaccacagaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcatgagggttgggagtaaagctctcagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaaagccctgtgctgtgccgctgccatgaattgtagctgatttatgagataaaacctaattaccagc

SEQ ID NO: 143583 - DNA, 658 bp, Homo sapiens
  Payload ID: 8359
  Gene Symbol: IRF9
  Gene Name: interferon regulatory factor 9
  ENST ID: ENST00000324076
  CDS Start-End: 1-630
gagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcac

SEQ ID NO: 143584 - DNA, 1838 bp, Homo sapiens
  Payload ID: 8359
  Gene Symbol: IRF9
  Gene Name: interferon regulatory factor 9
  Uniprot ID: Q00978
  ENST ID: ENST00000396864
  CDS Start-End: 288-1469
atctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatccttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 143585 - DNA, 1391 bp, Homo sapiens
  Payload ID: 8359
  Gene Symbol: IRF9
  Gene Name: interferon regulatory factor 9
  ENST ID: ENST00000557894
  CDS Start-End: 193-1254
cagccgcccagccaggagttaagctgaggtcgtctgagccctgcgacagcctggacagcaactcaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagatcctccatgtagcctatgcatggcactcctgcgcttgtgtgttgcatatcctgtgtggccatatgcccagcctggcagctacctggcagctctcctccagccaagacaatggaagaggtggttcagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttt

SEQ ID NO: 143586 - DNA, 583 bp, Homo sapiens
  Payload ID: 8359
  Gene Symbol: IRF9
  Gene Name: interferon regulatory factor 9
  ENST ID: ENST00000559284
  CDS Start-End: 48-583
aagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatttacagacacaactgaggccccctttcaaggggatcagagg

SEQ ID NO: 143587 - DNA, 1066 bp, Homo sapiens
  Payload ID: 8359
  Gene Symbol: IRF9
  Gene Name: interferon regulatory factor 9
  ENST ID: ENST00000561342
  CDS Start-End: 64-216
cgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactg

SEQ ID NO: 143588 - DNA, 731 bp, Homo sapiens
  Payload ID: 8359
  Gene Symbol: IRF9
  Gene Name: interferon regulatory factor 9
  ENST ID: ENST00000560852
  CDS Start-End: 24-176
gacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgtaagagatggagagggaactgggtgggcctaagggcaggacagtaaccagagggagaggtgggccaatgaaagacactgtgtcttgggaggccgaggctggcagatcacgtgaggtcagaagttcgaaaccagcctcgaccaacatggtgagaacccgtctctactaaaaatacaaaaattagctgtgcgttgtggcatctgcctgtaatcccagctactcaggaggccgaggcaggagaatcgcttgaaccgggg

SEQ ID NO: 143589 - DNA, 841 bp, Homo sapiens
  Payload ID: 8359
  Gene Symbol: IRF9
  Gene Name: interferon regulatory factor 9
  ENST ID: ENST00000560275
  CDS Start-End: 40-841
gtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagcaccaggtagggctgttctatccccagactactcactgctgctcaccttcatctacaacgggcgcgtggtgggcgaggcccaggtgcaaagcctggattgccgccttgtggctgagccctcaggctctgagagcagcatggagcaggtgctgt

SEQ ID NO: 143590 - DNA, 1856 bp, Homo sapiens
  Payload ID: 8360
  Gene Symbol: ISG20
  Gene Name: interferon stimulated exonuclease gene 20kDa
  Uniprot ID: Q96AZ6
  ENST ID: ENST00000306072
  CDS Start-End: 359-904
atccactccacgaacgtcaaatgcgtcatctgaggagggggagggccggggcaaaggaggggcaccctgacatggagcctgccagctccgtcagccctgactcggcccggagctgagctccccacctgccggtagcccaggagatggagcagcccagcccacgtgcccggccttccgcccctgacttcacttgataacaaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctacacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgccatcactgggtcctcttcttattcttctctccaagctgggttaacagtagacaggacccatttctgtgtgatgttaggagggaatgaagtcttatgctggggaggtgggcaagtatcaatttccttaatatcttgaatcctgtgggtccaaaatgtggcttggaaatctaagtagcatgtggcttaattactaatcccaccctttgctgttgcatcccagccctattcctggtgcatttatgcccagagaggtggcattatttcctggggtggcattcagctcctcttgagttggtgccacagcatttgtgggctttgaagcaaaggtacaggaaatgtcaagggtgccaccccggcaaccttgagcaagtcacccctcctatttgtaaaatgaggaaggaaaggtaacaaactgtggagtcagagagaagtaggttggaatcctctttgtcatttagtagctgtttgacctaaggtggtttactgaacttctcagtttctccatctgtaaaatgagaattctagcaactcgtagggtatttgtgagatgttgcaggcaaagcccccagcaccatgcctgtcctagcttaagcacccaccaggtgtcgataagtaattgttcttccctggactgcctgcacatctagggcaccccaggaagagtcaccgcactctgtttcggggctcggctctctgaggggagggcatcctgtatggggaggagggtctggaccagagctgtccctgatcgctagaatcaacggcagaattcttgttattttaataataattaataatttagtgcttccactaaataaaaatcattggaatggtg

SEQ ID NO: 143591 - DNA, 540 bp, Homo sapiens
  Payload ID: 8360
  Gene Symbol: ISG20
  Gene Name: interferon stimulated exonuclease gene 20kDa
  ENST ID: ENST00000379224
  CDS Start-End: 161-424
aaactagaaactgaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagaggtccccttcccatcctctccaacggcagctgagtgaaagcaagctgactggcctgtgtgaccagagcagggcaggctgtccatgtgggaggcgaggcgaggaacgcggggctggggcagtcacagctgggcgcctgggctgctggaggcctg

SEQ ID NO: 143592 - DNA, 800 bp, Homo sapiens
  Payload ID: 8360
  Gene Symbol: ISG20
  Gene Name: interferon stimulated exonuclease gene 20kDa
  Uniprot ID: Q96AZ6
  ENST ID: ENST00000560741
  CDS Start-End: 165-710
tatggtcattacaggtggtcagctgtagctggatgtgtgccttgaaaggctgacaagtttgccctgagtgactcacctactgtcacctgatccaacaagatttgtgggcgtagcctgccgatgggtgacgccagttaaagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctacacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatag

SEQ ID NO: 143593 - DNA, 614 bp, Homo sapiens
  Payload ID: 8360
  Gene Symbol: ISG20
  Gene Name: interferon stimulated exonuclease gene 20kDa
  ENST ID: ENST00000559876
  CDS Start-End: 149-614
gaaacagggtcgggatgccgatgccggcttggagttagagatgagtcaccgctgagagcagctgcagtagctgagcagtggcagcagagaggcagacgtgagctgagggcgcagaggcaggcagcatctctgagggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagaggcactgaaagaggacatgagcggctacacaatctacgacacgtccactgacaggctgttgtggcgtgaggccaagctggaccactgcaggcgtgtctccctgcgggtgctgagtgagcgcctcctacacaagagcatccagaacagcctgcttggacacagctcggtggaagatgcgagggcaacgatggagctctatcaaatctcccagagaatccgagcccgccgagggctgcccc

SEQ ID NO: 143594 - DNA, 3303 bp, Homo sapiens
  Payload ID: 8361
  Gene Symbol: ISG20L2
  Gene Name: interferon stimulated exonuclease gene 20kDa-like 2
  Uniprot ID: Q9H9L3
  ENST ID: ENST00000313146
  CDS Start-End: 784-1845
ttagctggacccgtctgggaggtaggtttgtgagcgtgagagatcgatctgtaccgcggggatccgaagtatgcttatccaggtgggctgcctcaagcctcgatcccacccccgcgctggtagatggtgtcaaggtccttgcgtgggagaaggacttgggtgagatgcatgcggagattgcccccaattccggcctggagccaagggaaagggatgcctggatttgtgtctctattggtggtccacgctgcggatgcctgggtagcccagaggttatctacgccatacttctcactgtttttgagcatacctagatgttcctttcctaggcggagtatagatcgcacgtgttctagcctcttagactcagagggttcgagctctataagcccctccactcccttcattttacaaatgagactcaaacctagagcgcggtaatgaccttactaagaccaaatggctggtgaattgggcttcactagaatccaggcttgctggctaacaccaatgctccctccatcatttcatgttatgttttcatttcccctctgtctgagagattgctctgatgtctttccttccataagtcctacggagatcgagcttacctcatttttctcccaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacacctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaatttattaacctggttggttaataaattgtgtggtccctgccgggcgtggtggctcacgcctgtaatcccagcactttgggaggccgagacgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaa

SEQ ID NO: 143595 - DNA, 2310 bp, Homo sapiens
  Payload ID: 8361
  Gene Symbol: ISG20L2
  Gene Name: interferon stimulated exonuclease gene 20kDa-like 2
  Uniprot ID: Q9H9L3
  ENST ID: ENST00000368219
  CDS Start-End: 503-1564
gcgggccaagttccagttcccgccccttgccgtacactcctctcctcttacggaagtgaagccggaggtgtccggcgggctgcagttccggtttatcgcggccttcccacaccttcgcgttgtaccaccacggggctagaggggccggggagcgcatcccgcccccgcccccacccacgccgccccctcctccgccgccactgccgctcctcacacactcggaatcactggcctcactacctggggtcggggcggtgcgggtgtgcgcgcgccgacctctggcgcgttctaacccgcgcgcctgccttcccgggcttcgtcggcgcgcaccgatttccgcatccggctccggacgcttccggtcttagctggacccgtctgggagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactaccgaaccaggtggagtggtatccggaagcagcacatggtgaatgccacacccttcaagattgctcgaggccagatcttgaagatactcacagggaagatagtggtggggcatgccatccacaacgacttcaaagcccttcagtactttcaccccaagtccctcacccgtgacacctcccatatcccccccctcaaccggaaggctgactgcccggagaatgccaccatgtctctgaagcatctcaccaagaagctgctaaaccgggatatccaggttgggaagagcggacattcctctgtggaagatgcccaggccaccatggagctatataagttggttgaagtcgagtgggaagagcacctagcccggaatccccctacagactagtggcagtggggacgctggtgatatgaggaggcagaggcagcacccaggagaaacagggcagtggaccaatggacagctccaccagctccacatctttggaagctagatttggggagagagaagctctaccccagacttaatacccattgaaatttcacctcaggtgttgtgtcctgtgtctggttaagtgtcccatggaaggggaaagccttcacgtcagaacccaaccctataccttttacttcttaaatggtgctaaccacaggtgtcccagggtgctctgtgccagttaagatttttaactttcaaggggcagggcatactgggaaatgtagtttcccaaactgccttatcacttgggtggacatatgtctccttttatgccttttggtcttgagtaattaacagcatcctcttccacgctcagaagtgttctggttggggccaggcatggtggctcacacctgtagtcccaacacttagggaggccgaggcgggcggatcacctgagatcaggagttcaagaccagcctggccaacatggcgaattcccgttctctactaaaaatacaaaaaatgtgtggggtgtggtggcaggagcctgtaatcctagctactcaggaggctgaggcaggagaatcgcttgagcccaggaggcggagattgcagtgagccgagatcgtgtcactgcactccagcctgggtgacaagagtgagactccgtctccaaaaaaaaaaaaaaagaa

SEQ ID NO: 143596 - DNA, 863 bp, Homo sapiens
  Payload ID: 8362
  Gene Symbol: IFNA1
  Gene Name: interferon, alpha 1
  Uniprot ID: P01562
  ENST ID: ENST00000276927
  CDS Start-End: 55-624
caaggttcagagtcacccatctcagcaagcccagaagtatctgcaatatctacgatggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaattctgtcatttcaaagactctcacccctgctataactatgaccatgctgataaactgatttatctatttaaatatttatttaactattcataagatttaaattatttttgttcatataacgtcatgtgcacctttacactgtggttagtgtaataaaacatgttccttatatttactc

SEQ ID NO: 143597 - DNA, 640 bp, Homo sapiens
  Payload ID: 8362
  Gene Symbol: IFNA1
  Gene Name: interferon, alpha 1
  ENST ID: ENST00000613815
  CDS Start-End: 9-578
catctacaatggccttgactttttatttactggtggccctagtggtgctcagctacaagtcattcagctctctgggctgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaat

SEQ ID NO: 143598 - DNA, 963 bp, Homo sapiens
  Payload ID: 8363
  Gene Symbol: IFNA10
  Gene Name: interferon, alpha 10
  Uniprot ID: P01566
  ENST ID: ENST00000357374
  CDS Start-End: 47-616
caaggttatccatctcaagtagcctagcaatatttgcaacatcccaatggccctgtccttttctttacttatggccgtgctggtgctcagctacaaatccatctgttctctaggctgtgatctgcctcagacccacagcctgggtaataggagggccttgatactcctgggacaaatgggaagaatctctcctttctcctgcctgaaggacagacatgatttccgaatcccccaggaggagtttgatggcaaccagttccagaaggctcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggactccatcctggctgtgaggaaatacttccaaagaatcactctttatctaatagagaggaaatacagcccttgtgcctgggaggttgtcagagcagaaatcatgagatccctctcgttttcaacaaacttgcaaaaaagattaaggaggaaggattgaaaactggttcaacatggcaatgatcctgattgactaatacattatctcacactttcatgagttcttccatttcaaagactcacttctataaccacgacgcgttgaatcaaaattttcaaatgttttcagcagtgtaaagaagtgtcgtgtatacctgtgcaggcactagtcctttacagatgaccattctgatgtctctgttcatcttttgtttaaatatttatttaattatttttaaaatttatgtaatatcatgagtcgctttacattgtggttaatgtaacaatatatgttcttcatatttagccaatatattaatttcctttttcattaaatttttactatac

SEQ ID NO: 143599 - DNA, 634 bp, Homo sapiens
  Payload ID: 8364
  Gene Symbol: IFNA13
  Gene Name: interferon, alpha 13
  Uniprot ID: P01562
  ENST ID: ENST00000449498
  CDS Start-End: 51-620
gttcagagtcacccatctcagcaagcccagaagcatctgcaatatctatgatggcctcgccctttgctttactgatggccctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacacctggtccaaca

SEQ ID NO: 143600 - DNA, 1539 bp, Homo sapiens
  Payload ID: 8364
  Gene Symbol: IFNA13
  Gene Name: interferon, alpha 13
  ENST ID: ENST00000610660
  CDS Start-End: 953-1525
agatctcaaagtcatatcatgagaggtgtcctctgcatacatatggtttgtcactggccatcttatagatattgcttatgtttgatccttagcatttctgtctgtgttgtgggctttgaaatgaaatataaataatttatattttaacaattctactgaagttgttcaacacatctatatttaggtcaagaattgaagaaaaaattcttcacactctctaggtgagtatctagcagctagtgaagttaaaaattttctcacatgcaacaaaattaaaagttaagtataataaaaataaatgataaaaatattttaaattattaagtctttatcagtttcaaataattcataaacattcattacttagctgtataatgtttatctagaaacattagataatgtttataatttgttaaatttcttatgtaatttaatacattacaatttatatcagtaaataaactatattgaagcccacaagcaaatttagttataaagttaagttaaatttgaatagcgtttaaatttaacttttatcttaaaattttcatttggttatttttaaacttgcattgaataaaatgattaaactttgtactttttgagtatagagatatacatatagtacacaaatagatagatattatatctgtgttattaaattttcacggtgggttcaattaggaaaaaaaatctaaaaagtctctgggaacaagatgggggagacaataatgaaaaacaaaatggttgagaaacacggctctaaactcatgtaaagagttcaagaaggaaagcaaaaacagaaatggaaagtggtccagaagcattaagaaagtggaaatcagtatgttccctatttaaggcatctgcaggaagcaaagccttcagagaacctagagcccaaggttcagagtcacccatctcagcaagcccagaagcatctgcaatatctatgatggcctcgccctttgctttactgatggccctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacacctggtccaaca

SEQ ID NO: 143601 - DNA, 990 bp, Homo sapiens
  Payload ID: 8365
  Gene Symbol: IFNA14
  Gene Name: interferon, alpha 14
  Uniprot ID: P01570
  ENST ID: ENST00000380222
  CDS Start-End: 57-626
ccaaggttcagtgttacccctcatcaaccagcccagcagcatcttcgggattcccaatggcattgccctttgctttaatgatggccctggtggtgctcagctgcaagtcaagctgctctctgggctgtaatctgtctcaaacccacagcctgaataacaggaggactttgatgctcatggcacaaatgaggagaatctctcctttctcctgcctgaaggacagacatgactttgaatttccccaggaggaatttgatggcaaccagttccagaaagctcaagccatctctgtcctccatgagatgatgcagcagaccttcaatctcttcagcacaaagaactcatctgctgcttgggatgagaccctcctagaaaaattctacattgaacttttccagcaaatgaatgacctggaagcctgtgtgatacaggaggttggggtggaagagactcccctgatgaatgaggactccatcctggctgtgaagaaatacttccaaagaatcactctttatctgatggagaagaaatacagcccttgtgcctgggaggttgtcagagcagaaatcatgagatccctctctttttcaacaaacttgcaaaaaagattaaggaggaaggattgaaaactggttcatcatggaaatgattctcattgactaatacatcatctcacactttcatgagttcttccatttcaaagactcacttctcctataaccaccacaagttgaatcaaaattttcaaatgttttcaggagtgtaaagaagcatcatgtatacctgtgcaggcactagtcctttacagatgaccatgctgatgtctcctttcatctatttatttaaatatttatttatttaactatttttattatttaaattattttttatgtaatatcatgtgtacctttacattgtggttaatataacaaatatgttcttcatatttagccaatatattaatttcctttttcattaaatttttactat

SEQ ID NO: 143602 - DNA, 939 bp, Homo sapiens
  Payload ID: 8366
  Gene Symbol: IFNA16
  Gene Name: interferon, alpha 16
  Uniprot ID: P05015
  ENST ID: ENST00000380216
  CDS Start-End: 7-576
atcccaatggccctgtccttttctttactgatggccgtgctggtgctcagctacaaatccatctgttctctgggctgtgatctgcctcagactcacagcctgggtaataggagggccttgatactcctggcacaaatgggaagaatctctcatttctcctgcctgaaggacagatatgatttcggattcccccaggaggtgtttgatggcaaccagttccagaaggctcaagccatctctgccttccatgagatgatccagcagaccttcaatctcttcagcacaaaggattcatctgctgcttgggatgagaccctcctagacaaattctacattgaacttttccagcaactgaatgacctagaagcctgtgtgacacaggaggttggggtggaagagattgccctgatgaatgaggactccatcctggctgtgaggaaatactttcaaagaatcactctttatctgatggggaagaaatacagcccttgtgcctgggaggttgtcagagcagaaatcatgagatccttctctttttcaacaaacttgcaaaaaggattaagaaggaaggattgaaaactcattcaacatggaaatgatcctcattgattaatacatcatctcacactttcatgagttcttccatttcaaagactcacttctataaccaccacaagttgaatcaaaattttcaaatgttttcaggagtgtaaagaagcatcgtgtttacctgtgcaggcactagtcctttacagatgaccatgctgatgtctctattcatctatttatttaaatatttatttatttaactatttttaaggtttaaatcatgttttatgtaatatcatgtgtacctttacattttgcttaatgtaacaatatatgttcttcatatttagttaatatattaacttccttttcattaaatttttactatac

SEQ ID NO: 143603 - DNA, 980 bp, Homo sapiens
  Payload ID: 8367
  Gene Symbol: IFNA17
  Gene Name: interferon, alpha 17
  Uniprot ID: P01571
  ENST ID: ENST00000413767
  CDS Start-End: 50-619
gttcaaggttacccatctcaagtagcctagcaacatttgcaacatcccaatggccctgtccttttctttactgatggccgtgctggtgctcagctacaaatccatctgttctctaggctgtgatctgcctcagacccacagcctgggtaataggagggccttgatactcctggcacaaatgggaagaatctctcctttctcctgcctgaaggacagacatgactttggacttccccaggaggagtttgatggcaaccagttccagaagactcaagccatctctgtcctccatgagatgatccagcagaccttcaatctcttcagcacagaggactcatctgctgcttgggaacagagcctcctagaaaaattttccactgaactttaccagcaactgaataacctggaagcatgtgtgatacaggaggttgggatggaagagactcccctgatgaatgaggactccatcctggctgtgaggaaatacttccaaagaatcactctttatctaacagagaagaaatacagcccttgtgcctgggaggttgtcagagcagaaatcatgagatctctctctttttcaacaaacttgcaaaaaatattaaggaggaaggattgaaaactggttcaacatggcaatgatcctgattgactaatacattatctcacactttcatgagttcctccatttcaaagactcacttctataaccaccacgagttgaatcaaaattttcaaatgttttcagcagtgtaaagaagcgtcgtgtatacctgtgcaggcactagtactttacagatgaccatgctgatgtctctgttcatctatttatttaaatatttatttaattatttttaagatttaaattatttttttatgtaatatcatgtgtacctttacattgtggtgaatgtaacaatatatgttcttcatatttagccaatatattaatttcctttttcattaaatttttactatac

SEQ ID NO: 143604 - DNA, 1135 bp, Homo sapiens
  Payload ID: 8368
  Gene Symbol: IFNA2
  Gene Name: interferon, alpha 2
  Uniprot ID: P01563
  ENST ID: ENST00000380206
  CDS Start-End: 60-626
gagcctaaggtttaggctcacccatttcaaccagtctagcagcatctgcaacatctacaatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgaaaactggttcaacatggaaatgattttcattgattcgtatgccagctcacctttttatgatctgccatttcaaagactcatgtttctgctatgaccatgacacgatttaaatcttttcaaatgtttttaggagtattaatcaacattgtattcagctcttaaggcactagtcccttacagaggaccatgctgactgatccattatctatttaaatatttttaaaatattatttatttaactatttataaaacaacttatttttgttcatattatgtcatgtgcacctttgcacagtggttaatgtaataaaatatgttctttgtatttggtaaatttattttgtgttgttcattgaacttttgctatggaaacttttgtacttgtttattctttaaaatgaaattccaagcctaattgtgcaacctgattacagaataactggtacacttcatttatccatcaatattatattcaagatataagtaaaaataaactttctgtaaaccag

SEQ ID NO: 143605 - DNA, 1024 bp, Homo sapiens
  Payload ID: 8369
  Gene Symbol: IFNA21
  Gene Name: interferon, alpha 21
  Uniprot ID: P01568
  ENST ID: ENST00000380225
  CDS Start-End: 49-618
ttcaaggttacccatctcaagtagcctagcaatattggcaacatcccaatggccctgtccttttctttactgatggccgtgctggtgctcagctacaaatccatctgttctctgggctgtgatctgcctcagacccacagcctgggtaataggagggccttgatactcctggcacaaatgggaagaatctctcctttctcctgcctgaaggacagacatgactttggattcccccaggaggagtttgatggcaaccagttccagaaggctcaagccatctctgtcctccatgagatgatccagcagaccttcaatctcttcagcacaaaggactcatctgctacttgggaacagagcctcctagaaaaattttccactgaacttaaccagcagctgaatgacctggaagcctgcgtgatacaggaggttggggtggaagagactcccctgatgaatgtggactccatcctggctgtgaagaaatacttccaaagaatcactctttatctgacagagaagaaatacagcccttgtgcctgggaggttgtcagagcagaaatcatgagatccttctctttatcaaaaatttttcaagaaagattaaggaggaaggaatgaaacctgtttcaacatggaaatgatctgtattgactaatacaccagtccacacttctatgacttctgccatttcaaagactcatttctcctataaccaccgcatgagttgaatcaaaattttcagatcttttcaggagtgtaaggaaacatcatgtttacctgtgcaggcactagtcctttacagatgaccatgctgatagatctaattatctatctattgaaatatttatttatttattagatttaaattatttttgtccatgtaatattatgtgtacttttacattgtgttatatcaaaatatgttatttatatttagtcaatatattattttctttttattaatttttactattaaaacttcttatattatttgtttattctttaataaagaaataccaagccc

SEQ ID NO: 143606 - DNA, 978 bp, Homo sapiens
  Payload ID: 8370
  Gene Symbol: IFNA4
  Gene Name: interferon, alpha 4
  Uniprot ID: P05014
  ENST ID: ENST00000421715
  CDS Start-End: 141-710
acaactagggaatttagaaaatggaaattagtatgttcactatttaagacctatgcacagagcaaagtcttcagaaaacctagaggccgaagttcaaggttatccatctcaagtagcctagcaatatttgcaacatcccaatggccctgtccttttctttactgatggccgtgctggtgctcagctacaaatccatctgttctctgggctgtgatctgcctcagacccacagcctgggtaataggagggccttgatactcctggcacaaatgggaagaatctctcatttctcctgcctgaaggacagacatgatttcggattccccgaggaggagtttgatggccaccagttccagaaggctcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggactccatcctggctgtgaggaaatacttccaaagaatcactctttatctaacagagaagaaatacagcccttgtgcctgggaggttgtcagagcagaaatcatgagatccctctcgttttcaacaaacttgcaaaaaagattaaggaggaaggattgaaacctggttcaacatggaaatgatcctgattgactaatacattatctcacactttcatgagttcttccatttcaaagactcacttctataaccaccacgagttgaatcaaaattttcaaatgttttcagcagtgtgaagaagcttggtgtatacctgtgcaggcactagtcctttacagatgacaatgctgatgtctctgttcatctatttatttaaatatttatttatttttaaaatttaaattattttttatgtgatatcatgagt

SEQ ID NO: 143607 - DNA, 567 bp, Homo sapiens
  Payload ID: 8370
  Gene Symbol: IFNA4
  Gene Name: interferon, alpha 4
  ENST ID: ENST00000619448
  CDS Start-End: 1-567
atggccctgtccttttctttactgatggccgtgctggtgctcagctacaaatccatctgttctctaggctgtgatctgcctcagacccacagcctgggtaataggagggccttgatactcctggcacaaatgggaagaatctctcctttctcctgcctgaaggacagacatgactttggacttccccaggaggagtttgatggcaaccagttccagaaggctcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggactccatcctggctgtgaggaaatacttccaaagaatcactctttatctaacagagaagaaatacagcccttgtgcctgggaggttgtcagagcagaaatcatgagatccctctcgttttcaacaaacttgcaaaaaagattaaggaggaaggat

SEQ ID NO: 143608 - DNA, 987 bp, Homo sapiens
  Payload ID: 8371
  Gene Symbol: IFNA5
  Gene Name: interferon, alpha 5
  Uniprot ID: P01569
  ENST ID: ENST00000610521
  CDS Start-End: 57-626
cccaaggttcagggtcactcaatctcaacagcccagaagcatctgcaacctccccaatggccttgccctttgttttactgatggccctggtggtgctcaactgcaagtcaatctgttctctgggctgtgatctgcctcagacccacagcctgagtaacaggaggactttgatgataatggcacaaatgggaagaatctctcctttctcctgcctgaaggacagacatgactttggatttcctcaggaggagtttgatggcaaccagttccagaaggctcaagccatctctgtcctccatgagatgatccagcagaccttcaatctcttcagcacaaaggactcatctgctacttgggatgagacacttctagacaaattctacactgaactttaccagcagctgaatgacctggaagcctgtatgatgcaggaggttggagtggaagacactcctctgatgaatgtggactctatcctgactgtgagaaaatactttcaaagaatcaccctctatctgacagagaagaaatacagcccttgtgcatgggaggttgtcagagcagaaatcatgagatccttctctttatcagcaaacttgcaagaaagattaaggaggaaggaatgaaaactggttcaacatcgaaatgattctcattgactagtacaccatttcacacttcttgagttctgccgtttcaaatattaatttctgctatatccatgacttgagttgaatcaaaattttcaaacgtttcacacgtgttaagcaacacttctttagctccacagggacaaaatctttacagatgatcatgccaatctatctattctatctatttatctatctgtctgtcttctatctaatctatttaaatatttatttatttataagatttaaattattttaaattatgtttgttcaggtaatattacatccacctttactttgtggctaatataataaaatatgttctttatgttttgtc

SEQ ID NO: 143609 - DNA, 704 bp, Homo sapiens
  Payload ID: 8372
  Gene Symbol: IFNA6
  Gene Name: interferon, alpha 6
  ENST ID: ENST00000259555
  CDS Start-End: 67-639
agagaacctagagctgaaggttcagagtcacccatctcaacaagtccaacagcatctgcaacatctacaatggctttgccttttgctttactgatggccctggtggtgctcagctgcaagtcaagctgctctctggactgtgatctgcctcagacccacagcctgggtcacaggaggaccatgatgctcctggcacaaatgaggagaatctctcttttctcctgtctgaaggacagacatgacttcagatttccccaggaggagtttgatggcaaccagttccagaaggctgaagccatctctgtcctccatgaggtgattcagcagaccttcaacctcttcagcacaaaggactcatctgttgcttgggatgagaggcttctagacaaactctatactgaactttaccagcagctgaatgacctggaagcctgtgtgatgcaggaggtgtgggtgggagggactcccctgatgaatgaggactccatcctggctgtgagaaaatacttccaaagaatcactctctacctgacagagaaaaagtacagcccttgtgcctgggaggttgtcagagcagaaatcatgagatccttctcttcatcaagaaacttgcaagaaaggttaaggaggaaggaataagacctgatccaacacagaaacgactcccattgacgactacaccagcttgcactttcatgatctgc

SEQ ID NO: 143610 - DNA, 1544 bp, Homo sapiens
  Payload ID: 8372
  Gene Symbol: IFNA6
  Gene Name: interferon, alpha 6
  Uniprot ID: P05013
  ENST ID: ENST00000380210
  CDS Start-End: 492-1061
tgctcagagttaagttaaatgtcaaatttttaaaaatttaacttttagttaaattactttgccattcctaacagatcaagaaataataaaagtaaactttatgctttttcttttagtgtgcaaagtagacatacatacagtacataaggagatatacaatatatttgttattaaaatttaataaaaatttaatttcaattaagaaaaaaatttcttaaaagactctggaggcaggcaagagaagggagtgtcaataatgaccacatacacacacaaacacacacacaaaactggttgaaaaactactctatacccatgtagagagtaaataaatgaaagcaaaatcagacgtagaaagtaaattctgaaaatggaaactagtatgttccctatttaagacctacacataaagcaaggtcttcagagaacctagagctgaaggttcagagtcacccatctcaacaagtccaacagcatctgcaacatctacaatggctttgccttttgctttactgatggccctggtggtgctcagctgcaagtcaagctgctctctggactgtgatctgcctcagacccacagcctgggtcacaggaggaccatgatgctcctggcacaaatgaggagaatctctcttttctcctgtctgaaggacagacatgacttcagatttccccaggaggagtttgatggcaaccagttccagaaggctgaagccatctctgtcctccatgaggtgattcagcagaccttcaacctcttcagcacaaaggactcatctgttgcttgggatgagaggcttctagacaaactctatactgaactttaccagcagctgaatgacctggaagcctgtgtgatgcaggaggtgtgggtgggagggactcccctgatgaatgaggactccatcctggctgtgagaaaatacttccaaagaatcactctctacctgacagagaaaaagtacagcccttgtgcctgggaggttgtcagagcagaaatcatgagatccttctcttcatcaagaaacttgcaagaaaggttaaggaggaaggaataagacctgatccaacacagaaacgactcccattgacgactacaccagcttgcactttcatgatctgccattttaaagactcttgtttctgctataaccataccatgagttgaatcaaacgcgtcaagtattttcaagtgtgttaagcaacatcgtgttcagttgcacaggaactagtcccttacagatgactaagctgatggatctatttatctatttattaaatgtatatttatttgactataatatttaattttttgcccatataaaagcataaaatgtatacctttatattgttgataacataacaaaatatattttctatgtttagtcgatgtattattttgtttagtttattaaatatttactatagaaaacttcttggatttgtttattctctaaggagaaacaccaagccgattctccaacatgatttaaaaatgtatggttcaattcattgattcattgttattatactcaagttat

SEQ ID NO: 143611 - DNA, 737 bp, Homo sapiens
  Payload ID: 8373
  Gene Symbol: IFNA7
  Gene Name: interferon, alpha 7
  Uniprot ID: P01567
  ENST ID: ENST00000239347
  CDS Start-End: 41-610
tacccacctcaggtagcctagtgatatttgcaaaatcccaatggcccggtccttttctttactgatggtcgtgctggtactcagctacaaatccatctgctctctgggctgtgatctgcctcagacccacagcctgcgtaataggagggccttgatactcctggcacaaatgggaagaatctctcctttctcctgcttgaaggacagacatgaattcagattcccagaggaggagtttgatggccaccagttccagaagactcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggacttcatcctggctgtgaggaaatacttccaaagaatcactctttatctaatggagaagaaatacagcccttgtgcctgggaggttgtcagagcagaaatcatgagatccttctctttttcaacaaacttgaaaaaaggattaaggaggaaggattgaaaactggttcatcatggaaatgattctcattgactaatgcatcatctcacactttcatgagttcttccatttcaaagactcacttctataaccaccacaagttgaatcaaaatttccaaatgttttc

SEQ ID NO: 143612 - DNA, 1039 bp, Homo sapiens
  Payload ID: 8374
  Gene Symbol: IFNA8
  Gene Name: interferon, alpha 8
  Uniprot ID: P32881
  ENST ID: ENST00000380205
  CDS Start-End: 31-600
accagctcagcagcatccacaacatctacaatggccttgactttttatttactggtggccctagtggtgctcagctacaagtcattcagctctctgggctgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggactcatctgctgctttggatgagacccttctagatgaattctacatcgaacttgaccagcagctgaatgacctggagtcctgtgtgatgcaggaagtgggggtgatagagtctcccctgatgtacgaggactccatcctggctgtgaggaaatacttccaaagaatcactctatatctgacagagaagaaatacagctcttgtgcctgggaggttgtcagagcagaaatcatgagatccttctctttatcaatcaacttgcaaaaaagattgaagagtaaggaatgagacctggtacaacacggaaatgattcttatagactaatacagcagctcacacttcgacaagttgtgctctttcaaagacccttgtttctgccaaaaccatgctatgaattgaatcaaatgtgtcaagtgttttcaggagtgttaagcaacatcctgttcagctgtatgggcactagtcccttacagatgaccatgctgatggatctattcatctatttatttaaatctttatttagttaactatctatagggcttaaattagttttgttcatattatattatgtgaacttttacattgtgaattgtgtaacaaaaacatgttctttatatttattattttgccttgtttattaaatttttactatagaaaaattctttatttattctttaaaattgaactccaaccctgattgtgcaaactgattaaagaatggatggt

SEQ ID NO: 143613 - DNA, 275 bp, Homo sapiens
  Payload ID: 8375
  Gene Symbol: IFI27
  Gene Name: interferon, alpha-inducible protein 27
  ENST ID: ENST00000555819
  CDS Start-End: 155-275
cggtgaggtcagcttcacattctcaggaactctccttctttggggagcctcagatgggaagggactcgagccccacctgtccctggactctggaatgtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggag

SEQ ID NO: 143614 - DNA, 716 bp, Homo sapiens
  Payload ID: 8375
  Gene Symbol: IFI27
  Gene Name: interferon, alpha-inducible protein 27
  ENST ID: ENST00000616764
  CDS Start-End: 177-545
gggaacacatccaagcttaagacggtgaggtcagcttcacattctcaggaactctccttctttggggagcctcagatgggaagggactcgagccccacctgtccctggactctggaatgtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttccc

SEQ ID NO: 143615 - DNA, 364 bp, Homo sapiens
  Payload ID: 8375
  Gene Symbol: IFI27
  Gene Name: interferon, alpha-inducible protein 27
  ENST ID: ENST00000618200
  CDS Start-End: 76-364
gcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaa

SEQ ID NO: 143616 - DNA, 692 bp, Homo sapiens
  Payload ID: 8375
  Gene Symbol: IFI27
  Gene Name: interferon, alpha-inducible protein 27
  ENST ID: ENST00000614204
  CDS Start-End: 498-692
gggggtaagagacagtgagtgcccaaacacagcgtcctgtacagacagcttgggcgttgttctcagggaagactgcgcctcgaagatccttggaggaaaccaaagtgggctcccagccaggttcgctgcttctgtctctgtctctgtctcgttattctcaccgctccagccattaaggaagagcacaccggacccgaaggatgcagcatgtgacagaatctccttcctcgataaggctgaatgacattccaccggaggtatagaccacatttggttgatccattcacccatcagtggacacttgggctgcttccacctctcggctattgtgcatagtgctgctatgtacgtgggggcagtgcttcagtcggggtggagctgcttaaaaggcctgggatcacaccctttgggaacacatccaagcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctcc

SEQ ID NO: 143617 - DNA, 505 bp, Homo sapiens
  Payload ID: 8375
  Gene Symbol: IFI27
  Gene Name: interferon, alpha-inducible protein 27
  ENST ID: ENST00000618863
  CDS Start-End: 103-342
ggaacacatccaagcttaagacggtgaggtcagcttcacattctcaggaactctccttctttggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaa

SEQ ID NO: 143618 - DNA, 719 bp, Homo sapiens
  Payload ID: 8375
  Gene Symbol: IFI27
  Gene Name: interferon, alpha-inducible protein 27
  ENST ID: ENST00000620066
  CDS Start-End: 189-548
ggcaggagctacccttcccgtggccccggaccttgggtgggctgtgggctcagggagcggaggggaggccttaagcatccactctctgcccggtgtttttgttctcatcagggagcctcagatgggaagggactcgagccccacctgtccctggactctggaatgccacggaattaacccgagcaggcatggaggcctctgctctcacctcatcagcagtgaccagtgtggccaaagtggtcagggtggcctctggctctgccgtagttttgcccctggccaggattgctacagttgtgattggaggagtggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttccc

SEQ ID NO: 143619 - DNA, 666 bp, Homo sapiens
  Payload ID: 8375
  Gene Symbol: IFI27
  Gene Name: interferon, alpha-inducible protein 27
  ENST ID: ENST00000614288
  CDS Start-End: 1-331
ccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactggggtttctctgagggagatggaggagggagggaaggagcccaagccaggaacagtgcactcaggaagactcagcccgaagcagatttgctgggttacctggggcgtctcctcccctctggggtgcagcctccttccctgaagagcgaggctgcttctagctctggagttcaccatgggggttcatgcctgcagcagcctctccccaaacaaagaccccgagggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactct

SEQ ID NO: 143620 - DNA, 505 bp, Homo sapiens; identical to SEQ ID NO: 143617
  Payload ID: 8375
  Gene Symbol: IFI27
  Gene Name: interferon, alpha-inducible protein 27
  ENST ID: ENST00000615978
  CDS Start-End: 103-342

SEQ ID NO: 143621 - DNA, 227 bp, Homo sapiens
  Payload ID: 8375
  Gene Symbol: IFI27
  Gene Name: interferon, alpha-inducible protein 27
  ENST ID: ENST00000611954
  CDS Start-End: 48-227
acatccaagcttaagacggtgaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcggga

SEQ ID NO: 143622 - DNA, 725 bp, Homo sapiens
  Payload ID: 8375
  Gene Symbol: IFI27
  Gene Name: interferon, alpha-inducible protein 27
  ENST ID: ENST00000612813
  CDS Start-End: 189-557
ggcaggagctacccttcccgtggccccggaccttgggtgggctgtgggctcagggagcggaggggaggccttaagcatccactctctgcccggtgtttttgttctcatcagggagcctcagatgggaagggactcgagccccacctgtccctggactctggaatgccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 143623 - DNA, 644 bp, Homo sapiens
  Payload ID: 8375
  Gene Symbol: IFI27
  Gene Name: interferon, alpha-inducible protein 27
  ENST ID: ENST00000621160
  CDS Start-End: 108-476
ttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 143624 - DNA, 686 bp, Homo sapiens
  Payload ID: 8375
  Gene Symbol: IFI27
  Gene Name: interferon, alpha-inducible protein 27
  ENST ID: ENST00000612838
  CDS Start-End: 155-523
cggtgaggtcagcttcacattctcaggaactctccttctttggggagcctcagatgggaagggactcgagccccacctgtccctggactctggaatgtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaa

SEQ ID NO: 143625 - DNA, 599 bp, Homo sapiens
  Payload ID: 8375
  Gene Symbol: IFI27
  Gene Name: interferon, alpha-inducible protein 27
  ENST ID: ENST00000620396
  CDS Start-End: 95-433
gtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactc

SEQ ID NO: 143626 - DNA, 644 bp, Homo sapiens; identical to SEQ ID NO: 143623
  Payload ID: 8375
  Gene Symbol: IFI27
  Gene Name: interferon, alpha-inducible protein 27
  ENST ID: ENST00000613997
  CDS Start-End: 108-476

SEQ ID NO: 143627 - DNA, 719 bp, Homo sapiens; identical to SEQ ID NO: 143618
  Payload ID: 8375
  Gene Symbol: IFI27
  Gene Name: interferon, alpha-inducible protein 27
  ENST ID: ENST00000618321
  CDS Start-End: 189-548

SEQ ID NO: 143628 - DNA, 692 bp, Homo sapiens; identical to SEQ ID NO: 143616
  Payload ID: 8375
  Gene Symbol: IFI27
  Gene Name: interferon, alpha-inducible protein 27
  ENST ID: ENST00000630123
  CDS Start-End: 498-692

SEQ ID NO: 143629 - DNA, 599 bp, Homo sapiens; identical to SEQ ID NO: 143625
  Payload ID: 8375
  Gene Symbol: IFI27
  Gene Name: interferon, alpha-inducible protein 27
  ENST ID: ENST00000626715
  CDS Start-End: 95-433

SEQ ID NO: 143630 - DNA, 725 bp, Homo sapiens; identical to SEQ ID NO: 143622
  Payload ID: 8375
  Gene Symbol: IFI27
  Gene Name: interferon, alpha-inducible protein 27
  ENST ID: ENST00000627111
  CDS Start-End: 189-557

SEQ ID NO: 143631 - DNA, 227 bp, Homo sapiens; identical to SEQ ID NO: 143621
  Payload ID: 8375
  Gene Symbol: IFI27
  Gene Name: interferon, alpha-inducible protein 27
  ENST ID: ENST00000631302
  CDS Start-End: 48-227

SEQ ID NO: 143632 - DNA, 666 bp, Homo sapiens; identical to SEQ ID NO: 143619
  Payload ID: 8375
  Gene Symbol: IFI27
  Gene Name: interferon, alpha-inducible protein 27
  ENST ID: ENST00000630342
  CDS Start-End: 1-331

SEQ ID NO: 143633 - DNA, 674 bp, Homo sapiens
  Payload ID: 8376
  Gene Symbol: IFI27L1
  Gene Name: interferon, alpha-inducible protein 27-like 1
  Uniprot ID: Q96BM0
  ENST ID: ENST00000393115
  CDS Start-End: 219-533
gcttggggcgctggcacctcctcttacagctttactcctgccagcttgggaaaaggccggagaaggtgaaattctgtgtgctccctccggcgagagactttgtcagctcccgcacagtaacctttattcaaaccagatcctgaataaagtcaaaactcaaccaacaggtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 143634 - DNA, 413 bp, Homo sapiens
  Payload ID: 8376
  Gene Symbol: IFI27L1
  Gene Name: interferon, alpha-inducible protein 27-like 1
  ENST ID: ENST00000557218
  CDS Start-End: 120-272
aggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcaggcagggctgctgtagcagctgtggtcggaggaggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 143635 - DNA, 571 bp, Homo sapiens
  Payload ID: 8376
  Gene Symbol: IFI27L1
  Gene Name: interferon, alpha-inducible protein 27-like 1
  ENST ID: ENST00000554562
  CDS Start-End: 32-310
gtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggtgagtgttctggacaggatgaccagagccaggagatgatccagccccgaggctgaaccagggaggcctctcctctccctgcaggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 143636 - DNA, 647 bp, Homo sapiens
  Payload ID: 8376
  Gene Symbol: IFI27L1
  Gene Name: interferon, alpha-inducible protein 27-like 1
  ENST ID: ENST00000553664
  CDS Start-End: 126-443
cctgccagcttgggaaaaggccggagaaggtgaaattctgtgtgctccctccggcgagagactttgtcagctcccgcacagtaactagcagaagcagagtcccaggatccatttcttacgttactatgcgagatgcagaaggtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatctt

SEQ ID NO: 143637 - DNA, 804 bp, Homo sapiens
  Payload ID: 8376
  Gene Symbol: IFI27L1
  Gene Name: interferon, alpha-inducible protein 27-like 1
  ENST ID: ENST00000556381
  CDS Start-End: 336-611
agctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcagcaggaaggcttttggcctgagctgctgagaggatggattccgggttcagcagtgacttgggccagagcagaggcagagagacaagttaggaagctcctccagtcatcccactgagagacgcgggtggcttggtccgggactggagctgcagaagtatgagggatggtcagactggatatttctgaaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggtgagtgttctggacaggatgaccagagccaggagatgatccagccccgaggctgaaccagggaggcctctcctctccctgcaggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttcc

SEQ ID NO: 143638 - DNA, 629 bp, Homo sapiens
  Payload ID: 8376
  Gene Symbol: IFI27L1
  Gene Name: interferon, alpha-inducible protein 27-like 1
  ENST ID: ENST00000555341
  CDS Start-End: 345-629
tgggaaaaggccggagaaggtgaaattctgtgtgctccctccggcgagagactttgtcagctcccgcacagtaacatcctgaataaagtcaaaactcaaccaacaggtggaagtccaagaatccgagtggaggctcaccgaggcgaaggggccaaccatgggaaaggagagtggatgggactcaggaaggcttttggcctgagctgctgagaggatggattccgggttcagcagtgacttgggccagagcagaggcagagagacaagttaggaagctcctccagtcatcccactgagagacgcgggtggcttggtccgggactggagctgcagaagtatgagggatggtcagactggatatttctgaaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcc

SEQ ID NO: 143639 - DNA, 406 bp, Homo sapiens
  Payload ID: 8376
  Gene Symbol: IFI27L1
  Gene Name: interferon, alpha-inducible protein 27-like 1
  ENST ID: ENST00000554544
  CDS Start-End: 146-265
ggagaaggtgaaattctgtgtgctccctccggcgagagactttgtcagctcccgcacagtaacatcctgaataaagtcaaaactcaaccaacaggtggaagtccaagaatccgagtggaggctcaccgaggcgaaggggccaaccatgggaaaggagagtggatgggactcaggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 143640 - DNA, 680 bp, Homo sapiens
  Payload ID: 8376
  Gene Symbol: IFI27L1
  Gene Name: interferon, alpha-inducible protein 27-like 1
  Uniprot ID: Q96BM0
  ENST ID: ENST00000555523
  CDS Start-End: 220-534
cctgattggctgcctcgcggaccgcagcagtgccggcgggagagctggcttggggcgctggcacctcctcttacagctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttctccta

SEQ ID NO: 143641 - DNA, 580 bp, Homo sapiens
  Payload ID: 8376
  Gene Symbol: IFI27L1
  Gene Name: interferon, alpha-inducible protein 27-like 1
  ENST ID: ENST00000557066
  CDS Start-End: 287-439
gaaattctgtgtgctccctccggcgagagactttgtcagctcccgcacagtaactcttcctgtgtgaggtccaagcaccctctcttggagtctggattgggacccctttccagtaatatactcctggtgaaccatgaaaggacgatattgaggagacccctgaactaaaggaaatagaccgcaacaccaattggctgactttggatcctgaataaagtcaaaactcaaccaacaggtggaagtccaagaatccgagtggaggctcaccgaggcgaaggggccaaccatgggaaaggagagtggatgggactcaggcagggctgctgtagcagctgtggtcggaggaggggcagctggactctctgtgacatctaaagttatcgggggctttgctgggacagctcttggggcctggctgggttcacccccttccagctgaacaccacactgaggcagggagttggctctcttggtggagatgactttcctgggcctctggatgacaatcttccaaaggacaagtctcctactcccaaaactatttaaggaagcatgaaaaataaagatgctggttatcttc

SEQ ID NO: 143642 - DNA, 615 bp, Homo sapiens
  Payload ID: 8376
  Gene Symbol: IFI27L1
  Gene Name: interferon, alpha-inducible protein 27-like 1
  ENST ID: ENST00000554166
  CDS Start-End: 336-615
agctttactcctgccagcttgggaaaaggccggagaaggtgaaattctgtgtgctccctccggcgagagactttgtcagctcccgcacagtaacgtggaagtccaagaatccgagtggaggctcaccgaggcgaaggggccaaccatgggaaaggagagtggatgggactcagcaggaaggcttttggcctgagctgctgagaggatggattccgggttcagcagtgacttgggccagagcagaggcagagagacaagttaggaagctcctccagtcatcccactgagagacgcgggtggcttggtccgggactggagctgcagaagtatgagggatggtcagactggatatttctgaaggcagggctgctgtagcagctgtggtcggaggagttgtggctgtggggactgtgctcgtggcgctcagtgccatgggcttcacctcagtaggaatcgccgcatcctccatagcagccaagatgatgtctacagcagccattgccaacgggggcggagttgctgctggcagtctggtggctattctgcagtcagtgggggcagctggactctctgtgacatctaaagttatcgggggctttgctgggacagctcttg

SEQ ID NO: 143643 - DNA, 674 bp, Homo sapiens; identical to SEQ ID NO: 143633
  Payload ID: 8376
  Gene Symbol: IFI27L1
  Gene Name: interferon, alpha-inducible protein 27-like 1
  Uniprot ID: Q96BM0
  ENST ID: ENST00000611681
  CDS Start-End: 219-533

SEQ ID NO: 143644 - DNA, 804 bp, Homo sapiens; identical to SEQ ID NO: 143637
  Payload ID: 8376
  Gene Symbol: IFI27L1
  Gene Name: interferon, alpha-inducible protein 27-like 1
  ENST ID: ENST00000629798
  CDS Start-End: 336-611

SEQ ID NO: 143645 - DNA, 680 bp, Homo sapiens; identical to SEQ ID NO: 143640
  Payload ID: 8376
  Gene Symbol: IFI27L1
  Gene Name: interferon, alpha-inducible protein 27-like 1
  Uniprot ID: Q96BM0
  ENST ID: ENST00000629591
  CDS Start-End: 220-534

SEQ ID NO: 143646 - DNA, 413 bp, Homo sapiens; identical to SEQ ID NO: 143634
  Payload ID: 8376
  Gene Symbol: IFI27L1
  Gene Name: interferon, alpha-inducible protein 27-like 1
  ENST ID: ENST00000628436
  CDS Start-End: 120-272

SEQ ID NO: 143647 - DNA, 406 bp, Homo sapiens; identical to SEQ ID NO: 143639
  Payload ID: 8376
  Gene Symbol: IFI27L1
  Gene Name: interferon, alpha-inducible protein 27-like 1
  ENST ID: ENST00000627633
  CDS Start-End: 146-265

SEQ ID NO: 143648 - DNA, 580 bp, Homo sapiens; identical to SEQ ID NO: 143641
  Payload ID: 8376
  Gene Symbol: IFI27L1
  Gene Name: interferon, alpha-inducible protein 27-like 1
  ENST ID: ENST00000627939
  CDS Start-End: 287-439

SEQ ID NO: 143649 - DNA, 629 bp, Homo sapiens; identical to SEQ ID NO: 143638
  Payload ID: 8376
  Gene Symbol: IFI27L1
  Gene Name: interferon, alpha-inducible protein 27-like 1
  ENST ID: ENST00000627570
  CDS Start-End: 345-629

SEQ ID NO: 143650 - DNA, 571 bp, Homo sapiens; identical to SEQ ID NO: 143635
  Payload ID: 8376
  Gene Symbol: IFI27L1
  Gene Name: interferon, alpha-inducible protein 27-like 1
  ENST ID: ENST00000626801
  CDS Start-End: 32-310

SEQ ID NO: 143651 - DNA, 615 bp, Homo sapiens; identical to SEQ ID NO: 143642
  Payload ID: 8376
  Gene Symbol: IFI27L1
  Gene Name: interferon, alpha-inducible protein 27-like 1
  ENST ID: ENST00000627505
  CDS Start-End: 336-615

SEQ ID NO: 143652 - DNA, 647 bp, Homo sapiens; identical to SEQ ID NO: 143636
  Payload ID: 8376
  Gene Symbol: IFI27L1
  Gene Name: interferon, alpha-inducible protein 27-like 1
  ENST ID: ENST00000625811
  CDS Start-End: 126-443

SEQ ID NO: 143653 - DNA, 511 bp, Homo sapiens
  Payload ID: 8377
  Gene Symbol: IFI27L2
  Gene Name: interferon, alpha-inducible protein 27-like 2
  Uniprot ID: Q9H2X8
  ENST ID: ENST00000238609
  CDS Start-End: 101-493
ctagggcagagtaggcgcgtccctactggatggagggggaagtaacaccccaagaacgctgtcatttcctgggccaagttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatgcagatgca

SEQ ID NO: 143654 - DNA, 556 bp, Homo sapiens
  Payload ID: 8377
  Gene Symbol: IFI27L2
  Gene Name: interferon, alpha-inducible protein 27-like 2
  ENST ID: ENST00000556727
  CDS Start-End: 229-546
atcagagccgtcaaagcctcccagactcacagaagtgtacactacaagggtgaattttactttgtgtaaatcacctacaccttaataaacttgactttttaaaaatcttgatgaaggatattaagcagcctggggaaatctaaatggttgattaactaaaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggtgaacctccaaaacccccactcaagtcagagaaacatgaggaataaaggtcacatg

SEQ ID NO: 143655 - DNA, 511 bp, Homo sapiens; identical to SEQ ID NO: 143653
  Payload ID: 8377
  Gene Symbol: IFI27L2
  Gene Name: interferon, alpha-inducible protein 27-like 2
  Uniprot ID: Q9H2X8
  ENST ID: ENST00000619362
  CDS Start-End: 101-493

SEQ ID NO: 143656 - DNA, 556 bp, Homo sapiens; identical to SEQ ID NO: 143654
  Payload ID: 8377
  Gene Symbol: IFI27L2
  Gene Name: interferon, alpha-inducible protein 27-like 2
  ENST ID: ENST00000626155
  CDS Start-End: 229-546

SEQ ID NO: 143657 - DNA, 822 bp, Homo sapiens
  Payload ID: 8378
  Gene Symbol: IFI6
  Gene Name: interferon, alpha-inducible protein 6
  Uniprot ID: P09912
  ENST ID: ENST00000339145
  CDS Start-End: 89-505
gtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtgagaatgcgggtaaggatgcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaaca

SEQ ID NO: 143658 - DNA, 841 bp, Homo sapiens
  Payload ID: 8378
  Gene Symbol: IFI6
  Gene Name: interferon, alpha-inducible protein 6
  Uniprot ID: P09912
  ENST ID: ENST00000361157
  CDS Start-End: 129-521
aaaagccagccttcagccggagaaccgtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaacactt

SEQ ID NO: 143659 - DNA, 828 bp, Homo sapiens
  Payload ID: 8378
  Gene Symbol: IFI6
  Gene Name: interferon, alpha-inducible protein 6
  Uniprot ID: P09912
  ENST ID: ENST00000362020
  CDS Start-End: 109-513
agaaccgtttactcgctgctgtgcccatctatcagcaggctccgggctgaagattgcttctcttctctcctccaaggtctagtgacggagcccgcgcgcggcgccaccatgcggcagaaggcggtatcgcttttcttgtgctacctgctgctcttcacttgcagtggggtggaggcaggtgagaatgcgggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaa

SEQ ID NO: 143660 - DNA, 859 bp, Homo sapiens
  Payload ID: 8379
  Gene Symbol: IFNB1
  Gene Name: interferon, beta 1, fibroblast
  Uniprot ID: P01574
  ENST ID: ENST00000380232
  CDS Start-End: 95-658
ccatacccatggagaaaggacattctaactgcaacctttcgaagcctttgctctggcacaacaggtagtaggcgacactgttcgtgttgtcaacatgaccaacaagtgtctcctccaaattgctctcctgttgtgcttctccactacagctctttccatgagctacaacttgcttggattcctacaaagaagcagcaattttcagtgtcagaagctcctgtggcaattgaatgggaggcttgaatactgcctcaaggacaggatgaactttgacatccctgaggagattaagcagctgcagcagttccagaaggaggacgccgcattgaccatctatgagatgctccagaacatctttgctattttcagacaagattcatctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctaaggaacttttacttcattaacagacttacaggttacctccgaaactgaagatctcctagcctgtgcctctgggactggacaattgcttcaagcattcttcaaccagcagatgctgtttaagtgactgatggctaatgtactgcatatgaaaggacactagaagattttgaaatttttattaaattatgagttatttttatttatttaaattttattttggaaaataaattatttttggtgcaaaagtca

SEQ ID NO: 143661 - DNA, 1475 bp, Homo sapiens
  Payload ID: 8380
  Gene Symbol: IFNE
  Gene Name: interferon, epsilon
  Uniprot ID: Q86WN2
  ENST ID: ENST00000448696
  CDS Start-End: 620-1246
cttagatattaaactgataggataagatataaaataatttaagattgctgatatatgttttaaaattaattatttgctcaagcatttgtgacaatttacagttctaattgaggttttaaatttagtagtttgtaggtattttaagttttgcccctgaattctttataggtgctgataagcctttggtaagttttactccatgaaagactattactgaaaaaaacgtaatctcaataaaagaactttaataagcttgactaaatatttagaaagcacattgtgttcagtgaaactttgtatataatgaatagaataataaaagattatgttggatgactagtctgtaattgcctcaaggaaagcatacaatgaataagttattttggtacttcctcaaaatagccaacacaatagggaaatggagaaaatgtactctgaacaccatgaaaagggaacctgaaaatctaatgtgtaaacttggagaaatgacattagaaaacgaaagcaacaaaagagaacactctccaaaataatctgagatgcatgaaaggcaaacattcactagagctggaatttccctaagtctatgcagggataagtagcatatttgaccttcaccatgattatcaagcacttctttggaactgtgttggtgctgctggcctctaccactatcttctctctagatttgaaactgattatcttccagcaaagacaagtgaatcaagaaagtttaaaactcttgaataagttgcaaaccttgtcaattcagcagtgtctaccacacaggaaaaactttctgcttcctcagaagtctttgagtcctcagcagtaccaaaaaggacacactctggccattctccatgagatgcttcagcagatcttcagcctcttcagggcaaatatttctctggatggttgggaggaaaaccacacggagaaattcctcattcaacttcatcaacagctagaatacctagaagcactcatgggactggaagcagagaagctaagtggtactttgggtagtgataaccttagattacaagttaaaatgtacttccgaaggatccatgattacctggaaaaccaggactacagcacctgtgcctgggccattgtccaagtagaaatcagccgatgtctgttctttgtgttcagtctcacagaaaaactgagcaaacaaggaagacccttgaacgacatgaagcaagagcttactacagagtttagaagcccgaggtaggtggagggactagaggacttctccagacatgattcttcatagagtggtaatacaatttatagtacaatcacattgctttgattttgtgtatatatatatttatctgtgttttaagattgtgcatattgaccacaattgtttttattttgtaatgtggctttatatattctatccattttaaattgtttgtatgtcaaaataaattcattaatatggttgattcttcaaa

SEQ ID NO: 143662 - DNA, 1218 bp, Homo sapiens
  Payload ID: 8381
  Gene Symbol: IFNG
  Gene Name: interferon, gamma
  Uniprot ID: P01579
  ENST ID: ENST00000229135
  CDS Start-End: 133-633
gtgcagcacattgttctgatcatctgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctgcaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactgccggtttgaaaatatgcctgcaatctgagccagtgctttaatggcatgtcagacagaacttgaatgtgtcaggtgaccctgatgaaaacatagcatctcaggagatttcatgcctggtgcttccaaatattgttgacaactgtgactgtacccaaatggaaagtaactcatttgttaaaattatcaatatctaatatatatgaataaagtgtaagttcacaacta

SEQ ID NO: 143663 - DNA, 2867 bp, Homo sapiens
  Payload ID: 8382
  Gene Symbol: IFI16
  Gene Name: interferon, gamma-inducible protein 16
  Uniprot ID: Q16666
  ENST ID: ENST00000295809
  CDS Start-End: 256-2613
agaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaa

SEQ ID NO: 143664 - DNA, 2732 bp, Homo sapiens
  Payload ID: 8382
  Gene Symbol: IFI16
  Gene Name: interferon, gamma-inducible protein 16
  ENST ID: ENST00000340979
  CDS Start-End: 1749-2480
attgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagacagtcactaggaaacttggcattttattagaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaagg

SEQ ID NO: 143665 - DNA, 2609 bp, Homo sapiens
  Payload ID: 8382
  Gene Symbol: IFI16
  Gene Name: interferon, gamma-inducible protein 16
  Uniprot ID: Q16666
  ENST ID: ENST00000359709
  CDS Start-End: 173-2362
attttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtg

SEQ ID NO: 143666 - DNA, 2734 bp, Homo sapiens
  Payload ID: 8382
  Gene Symbol: IFI16
  Gene Name: interferon, gamma-inducible protein 16
  Uniprot ID: Q16666
  ENST ID: ENST00000368131
  CDS Start-End: 291-2480
attgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaggaa

SEQ ID NO: 143667 - DNA, 2704 bp, Homo sapiens
  Payload ID: 8382
  Gene Symbol: IFI16
  Gene Name: interferon, gamma-inducible protein 16
  Uniprot ID: Q16666
  ENST ID: ENST00000368132
  CDS Start-End: 265-2454
ggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaa

SEQ ID NO: 143668 - DNA, 2245 bp, Homo sapiens
  Payload ID: 8382
  Gene Symbol: IFI16
  Gene Name: interferon, gamma-inducible protein 16
  Uniprot ID: Q16666
  ENST ID: ENST00000448393
  CDS Start-End: 1-2022
atgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagcgtcagcttccatatccttcagaggccagcacaaccttccctgagagccatcttcggactcctcagatgccaccaacaactccatccagcagtttcttcaccaagttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaa

SEQ ID NO: 143669 - DNA, 761 bp, Homo sapiens
  Payload ID: 8382
  Gene Symbol: IFI16
  Gene Name: interferon, gamma-inducible protein 16
  ENST ID: ENST00000426592
  CDS Start-End: 260-761
actgtctgaaagactactcaggcgtgcactgcgaggtggagatctgacttctcttgttcccgcttaagactgcctcctgtatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccat

SEQ ID NO: 143670 - DNA, 951 bp, Homo sapiens
  Payload ID: 8382
  Gene Symbol: IFI16
  Gene Name: interferon, gamma-inducible protein 16
  ENST ID: ENST00000447473
  CDS Start-End: 411-951
tttatttgacatcctggggttacagcacgctaaagggcacccactgtccttaacagagaaaaatacactgctgagcagaggattaaacagactcctcacactaccggaagttcagtgcattttccaggattttcaagtcttcgatgctgtcatgttgagagtccactatccacgtttgtttatccaggaataatgcagaaaatctgagcattcgtgaatctaatcattgagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttctt

SEQ ID NO: 143671 - DNA, 546 bp, Homo sapiens
  Payload ID: 8382
  Gene Symbol: IFI16
  Gene Name: interferon, gamma-inducible protein 16
  ENST ID: ENST00000567661
  CDS Start-End: 324-546
agtgcttgttcctgtcttgtgactgctggtctccttaaggccaggctgggctaatgcagtagagctagactaaagcacagctgaaccctcaagcaggaactgagagcaaattgtattgaaactgcttcagctgtcggagatcgtttatatgtcttccttttttctgcattggttgggaataaaattgaatctattccagtaaaaggaccagccctatcaagaaagaggaagaaggaagtggatgctacttcacctgcaccctccacaagcagcactgtcaaaactgaaggagcagaggcaactcctggagctcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacag

SEQ ID NO: 143672 - DNA, 1095 bp, Homo sapiens
  Payload ID: 8382
  Gene Symbol: IFI16
  Gene Name: interferon, gamma-inducible protein 16
  ENST ID: ENST00000474473
  CDS Start-End: 409-1095
agtgcttgttcctgtcttgtgactgctggtctccttaaggccaggctgggctaatgcagtagagctagactaaagcacagctgaaccctcaagcaggaactgagagcaaattgtattgaaactgcttcagctgtcggagatcgtttatatgtcttccttttttctgcattggttgggaataaaattgaatctattccagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacagttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccag

SEQ ID NO: 143673 - DNA, 856 bp, Homo sapiens
  Payload ID: 8382
  Gene Symbol: IFI16
  Gene Name: interferon, gamma-inducible protein 16
  ENST ID: ENST00000566111
  CDS Start-End: 608-856
tcatcaacatgcattcccagaaatgccatgaaaggaaagaccaagtcttgactgagaaacggaccgggcagatgagggactcccacatatacctgtttcctgctcttcccgaagacattttgccacaagcatataattcagcttctgaaaaatacggtcttcctcactgcagacaccatgccagcgttttaaatcaagttggctactcgtgctgtttagagtatgcagtttgcctgtggcaatattaaactcatctggaagaaagcacttaaacctatccagttcctcatcggtgatgttatccaggctggttagcaagagtatctccttatatttactctccatctcacgacttttcagcttataagggatccaaactatgtaagattataccaccaaaagtgattcaacattcaaaatgaagcaagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaa

SEQ ID NO: 143674 - DNA, 1134 bp, Homo sapiens
  Payload ID: 8383
  Gene Symbol: IFI30
  Gene Name: interferon, gamma-inducible protein 30
  Uniprot ID: P13284
  ENST ID: ENST00000407280
  CDS Start-End: 176-928
gggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagc

SEQ ID NO: 143675 - DNA, 411 bp, Homo sapiens
  Payload ID: 8383
  Gene Symbol: IFI30
  Gene Name: interferon, gamma-inducible protein 30
  ENST ID: ENST00000597802
  CDS Start-End: 97-411
cagcttctgctttccggcgtggctgtggtcaagcctgagtcagtcccacgggaccacggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacag

SEQ ID NO: 143676 - DNA, 1140 bp, Homo sapiens
  Payload ID: 8384
  Gene Symbol: IFNK
  Gene Name: interferon, kappa
  Uniprot ID: Q9P0W0
  ENST ID: ENST00000276943
  CDS Start-End: 24-647
ggattttttagcttgcaaaaaaaatgagcaccaaacctgatatgattcaaaagtgtttgtggcttgagatccttatgggtatattcattgctggcaccctatccctggactgtaacttactgaacgttcacctgagaagagtcacctggcaaaatctgagacatctgagtagtatgagcaattcatttcctgtagaatgtctacgagaaaacatagcttttgagttgccccaagagtttctgcaatacacccaacctatgaagagggacatcaagaaggccttctatgaaatgtccctacaggccttcaacatcttcagccaacacaccttcaaatattggaaagagagacacctcaaacaaatccaaataggacttgatcagcaagcagagtacctgaaccaatgcttggaggaagacaagaatgaaaatgaagacatgaaagaaatgaaagagaatgagatgaaaccctcagaagccagggtcccccagctgagcagcctggaactgaggagatatttccacaggatagacaatttcctgaaagaaaagaaatacagtgactgtgcctgggagattgtccgagtggaaatcagaagatgtttgtattacttttacaaatttacagctctattcaggaggaaataagaatcatctaccttcaagcaagaattaacagagattgtggctacgcaaatgcaccaaaaaagggtgaaatatatctgaaatgtacctggttctgcccttggaagccatttcctgctcatgccactaacagcatgctgccaaactgttcagattcaagattattccaagcgcagggcccaaatgttatagccaaagaaagtcttatgataaaagtgaggcaaatttcagccaagaagttagaagagatgtttaaaagaacaagaacaaattgtggatcatggtatatgcaggctatcagcagaaggatcagacaataaaatgagttagtgcaaaccatttagtaaaaataactatcagcagagttgttccagattaaaaatagtactacaagcttgtaaaggagttaggacatgcaagctactgagcataaaatatatacttgctatttttcatgactttctctaataaagtctttgcctgttctctctaataa

SEQ ID NO: 143677 - DNA, 857 bp, Homo sapiens
  Payload ID: 8385
  Gene Symbol: IFNL1
  Gene Name: interferon, lambda 1
  Uniprot ID: Q8IU54
  ENST ID: ENST00000333625
  CDS Start-End: 98-700
aattaccttttcactttacacacatcatcttggattgcccattttgcgtggctaaaaagcagagccatgccgctggggaagcagttgcgatttagccatggctgcagcttggaccgtggtgctggtgactttggtgctaggcttggccgtggcaggccctgtccccacttccaagcccaccacaactgggaagggctgccacattggcaggttcaaatctctgtcaccacaggagctagcgagcttcaagaaggccagggacgccttggaagagtcactcaagctgaaaaactggagttgcagctctcctgtcttccccgggaattgggacctgaggcttctccaggtgagggagcgccctgtggccttggaggctgagctggccctgacgctgaaggtcctggaggccgctgctggcccagccctggaggacgtcctagaccagccccttcacaccctgcaccacatcctctcccagctccaggcctgtatccagcctcagcccacagcagggcccaggccccggggccgcctccaccactggctgcaccggctccaggaggcccccaaaaaggagtccgctggctgcctggaggcatctgtcaccttcaacctcttccgcctcctcacgcgagacctcaaatatgtggccgatgggaacctgtgtctgagaacgtcaacccaccctgagtccacctgacaccccacaccttatttatgcgctgagccctactccttccttaatttatttcctctcaccctttatttatgaagctgcagccctgactgagacatagggctgagtttattgttttacttttatacattatgcacaaataaacaacaaggaattggaa

SEQ ID NO: 143678 - DNA, 737 bp, Homo sapiens
  Payload ID: 8386
  Gene Symbol: IFNL2
  Gene Name: interferon, lambda 2
  Uniprot ID: Q8IZJ0
  ENST ID: ENST00000331982
  CDS Start-End: 56-658
ccctgggtgacagcctcagagtgtttcttctgctgacaaagaccagagatcaggaatgaaactagacatgactggggactgcacgccagtgctggtgctgatggccgcagtgctgaccgtgactggagcagttcctgtcgccaggctccacggggctctcccggatgcaaggggctgccacatagcccagttcaagtccctgtctccacaggagctgcaggcctttaagagggccaaagatgccttagaagagtcgcttctgctgaaggactgcaggtgccactcccgcctcttccccaggacctgggacctgaggcagctgcaggtgagggagcgccccatggctttggaggctgagctggccctgacgctgaaggttctggaggccaccgctgacactgacccagccctggtggacgtcttggaccagccccttcacaccctgcaccatatcctctcccagttccgggcctgtatccagcctcagcccacggcagggcccaggacccggggccgcctccaccattggctgtaccggctccaggaggccccaaaaaaggagtcccctggctgcctcgaggcctctgtcaccttcaacctcttccgcctcctcacgcgagacctgaattgtgttgccagtggggacctgtgtgtctgaccctcccaccagtcatgcaacctgagattttatttataaattagccacttgtcttaatttattgccacccagtcgctat

SEQ ID NO: 143679 - DNA, 656 bp, Homo sapiens
  Payload ID: 8387
  Gene Symbol: IFNL3
  Gene Name: interferon, lambda 3
  Uniprot ID: Q8IZI9
  ENST ID: ENST00000413851
  CDS Start-End: 40-630
ctgcattccctcagctccctttctctctgtgacacagacatgaccggggactgcatgccagtgctggtgctgatggccgcagtgctgaccgtgactggagcagttcctgtcgccaggctccgcggggctctcccggatgcaaggggctgccacatagcccagttcaagtccctgtctccacaggagctgcaggcctttaagagggccaaagatgccttagaagagtcgcttctgctgaaggactgcaagtgccgctcccgcctcttccccaggacctgggacctgaggcagctgcaggtgagggagcgccccgtggctttggaggctgagctggccctgacgctgaaggttctggaggccaccgctgacactgacccagccctgggggatgtcttggaccagccccttcacaccctgcaccatatcctctcccagctccgggcctgtatccagcctcagcccacggcagggcccaggacccggggccgcctccaccattggctgcaccggctccaggaggccccaaaaaaggagtcccctggctgcctcgaggcctctgtcaccttcaacctcttccgcctcctcacgcgagacctgaattgtgttgccagcggggacctgtgtgtctgacccttccgccagtcatgcaacctgag

SEQ ID NO: 143680 - DNA, 734 bp, Homo sapiens
  Payload ID: 8387
  Gene Symbol: IFNL3
  Gene Name: interferon, lambda 3
  ENST ID: ENST00000613087
  CDS Start-End: 53-655
tgggtgacagcctcagagtgtttcttctgctgacaaagaccagagatcaggaatgaaactagacatgaccggggactgcatgccagtgctggtgctgatggccgcagtgctgaccgtgactggagcagttcctgtcgccaggctccgcggggctctcccggatgcaaggggctgccacatagcccagttcaagtccctgtctccacaggagctgcaggcctttaagagggccaaagatgccttagaagagtcgcttctgctgaaggactgcaagtgccgctcccgcctcttccccaggacctgggacctgaggcagctgcaggtgagggagcgccccgtggctttggaggctgagctggccctgacgctgaaggttctggaggccaccgctgacactgacccagccctgggggatgtcttggaccagccccttcacaccctgcaccatatcctctcccagctccgggcctgtatccagcctcagcccacggcagggcccaggacccggggccgcctccaccattggctgcaccggctccaggaggccccaaaaaaggagtcccctggctgcctcgaggcctctgtcaccttcaacctcttccgcctcctcacgcgagacctgaattgtgttgccagcggggacctgtgtgtctgacccttccgccagtcatgcaacctgagattttatttataaattagccacttggcttaatttattgtcacccagtcgctat

SEQ ID NO: 143681 - DNA, 1637 bp, Homo sapiens
  Payload ID: 8388
  Gene Symbol: IFNL4
  Gene Name: interferon, lambda 4 (gene/pseudogene)
  ENST ID: ENST00000606380
  CDS Start-End: 278-818
gttgcccaggtggagacggctctggacgcctcccaggggacagtggacggcagcacctgctgcagcacgaggcacagagggtgcactgcagacaggagtgagggcagaggccaaggcgaggagggggccggctcccactctctctcccactgtgtgtgctgtgccttcacgctccgagcattgccttccctgggatcctaacccaaggcggggggctggacgcgctggaccctctctttggcttccctgacgtctctcgcctgctgcagaagcagagatgcggccgagtgtctgggccgcagtggccgcggggctgtgggtcctgtgcacggtgatcgcagaaggccccccggcgctgcctgctctcgcactaccgctcgctggagccccggacgctggcggctgccaaggcgctgagggaccgctacgaggaagaggcgctgagctgggggcagcgcaactgctccttccgccccaggagggatcctccgcggccatcgtcctgcgctcggctccgccacgtggcccggggcatcgcggacgcccaggcagtgctcagcggcctgcaccgctcggagctgctccccggcgccggcccgatcctggagctgctggcggccgcggggagggatgtggcggcctgccttgagctggcacggccaggctcctccaggaaggtccccggggcccagaagaggcgtcacaaaccccggagagcggactcgcctcggtgccgcaaagccagcgtggtcttcaacctcctgcgcctgctcacgtgggagctccggctggctgcacactctgggccttgcctctgaccccgccccctctggcagcacggaaacctccacgccattggctgccgaaagcagctcctgtcgtccattgggctggccgggcgaggctctcagtcaatgggtgctgaggcacgaaaacttcttcgcagccttgggcctgacttggatccactgtctcagatataagaggagcgggtccttctacagggaagagaccacagttctccaggaagccacgatatttcctcggggtgcattgtacgaccctccaacggttgctgtggcaggaaaaaacttgagctctggaaaccgtggctgaccccaggcaacagggaccagttcctccttgtgtggttaccaggacacccccaacaccaggtcctaaccccggatttgtagccccacagccagctttgagattctgtgaatccgtgactcttggatccggcatctaagggacaccaatccatgagggatttggtagtgaaaggcccaagggtccttaaccgactgtggttctttggattcccttacgtgtgtttgtatttgtgaagttcctgtgcatttgctattctgtctcccggtttaaatttattgccagttatcaaagagtgttttgatcgcattggttgttttccgtatgatgattgtgaggtgcaccttacagcaaaaaaagaggccgagccagggactcaggtggcctgagtttcagttctgaccctgccagttaattacagtggaattcagggcaaattacttttctgagcctctgtttcctcacctataggatgggttagcatacttgccttgtggaggagtagtgtccgttgagatcacgtt

SEQ ID NO: 143682 - DNA, 1132 bp, Homo sapiens
  Payload ID: 8388
  Gene Symbol: IFNL4
  Gene Name: interferon, lambda 4 (gene/pseudogene)
  ENST ID: ENST00000616270
  CDS Start-End: 278-709
gttgcccaggtggagacggctctggacgcctcccaggggacagtggacggcagcacctgctgcagcacgaggcacagagggtgcactgcagacaggagtgagggcagaggccaaggcgaggagggggccggctcccactctctctcccactgtgtgtgctgtgccttcacgctccgagcattgccttccctgggatcctaacccaaggcggggggctggacgcgctggaccctctctttggcttccctgacgtctctcgcctgctgcagaagcagagatgcggccgagtgtctgggccgcagtggccgcggggctgtgggtcctgtgcacggtgatcgcagaaggccccccggcgctgcctgctctcgcactaccgctcgctggagccccggacgctggcggctgccaaggcgctgagggaccgctacgaggaagaggcgctgagctgggggcagcgcaactgctccttccgccccaggagggatcctccgcggccatcgcttctctgcatcctcaggcccacggcgagccccagcgctttgccaatctgtcctgcttagcggaaaaacccatccagaccggagtcgggtcctctgggtgtcctgaaatccgggctcgagtctgcggctgggagggccacgggcagatgcagagaggggcttcgtccttcgccttttccatttgcctcatgtcccacctccagctttgagattctgtgaatccgtgactcttggatccggcatctaagggacaccaatccatgagggatttggtagtgaaaggcccaagggtccttaaccgactgtggttctttggattcccttacgtgtgtttgtatttgtgaagttcctgtgcatttgctattctgtctcccggtttaaatttattgccagttatcaaagagtgttttgatcgcattggttgttttccgtatgatgattgtgaggtgcaccttacagcaaaaaaagaggccgagccagggactcaggtggcctgagtttcagttctgaccctgccagttaattacagtggaattcagggcaaattacttttctgagcctctgtttcctcacctataggatgggttagcatacttgccttgtggaggagtagtgtccgttgagatcacgtt

SEQ ID NO: 143683 - DNA, 1636 bp, Homo sapiens
  Payload ID: 8388
  Gene Symbol: IFNL4
  Gene Name: interferon, lambda 4 (gene/pseudogene)
  ENST ID: ENST00000610963
  CDS Start-End: 278-817
gttgcccaggtggagacggctctggacgcctcccaggggacagtggacggcagcacctgctgcagcacgaggcacagagggtgcactgcagacaggagtgagggcagaggccaaggcgaggagggggccggctcccactctctctcccactgtgtgtgctgtgccttcacgctccgagcattgccttccctgggatcctaacccaaggcggggggctggacgcgctggaccctctctttggcttccctgacgtctctcgcctgctgcagaagcagagatgcggccgagtgtctgggccgcagtggccgcggggctgtgggtcctgtgcacggtgatcgcagaagccccccggcgctgcctgctctcgcactaccgctcgctggagccccggacgctggcggctgccaaggcgctgagggaccgctacgaggaagaggcgctgagctgggggcagcgcaactgctccttccgccccaggagggatcctccgcggccatcgtcctgcgctcggctccgccacgtggcccggggcatcgcggacgcccaggcagtgctcagcggcctgcaccgctcggagctgctccccggcgccggcccgatcctggagctgctggcggccgcggggagggatgtggcggcctgccttgagctggcacggccaggctcctccaggaaggtccccggggcccagaagaggcgtcacaaaccccggagagcggactcgcctcggtgccgcaaagccagcgtggtcttcaacctcctgcgcctgctcacgtgggagctccggctggctgcacactctgggccttgcctctgaccccgccccctctggcagcacggaaacctccacgccattggctgccgaaagcagctcctgtcgtccattgggctggccgggcgaggctctcagtcaatgggtgctgaggcacgaaaacttcttcgcagccttgggcctgacttggatccactgtctcagatataagaggagcgggtccttctacagggaagagaccacagttctccaggaagccacgatatttcctcggggtgcattgtacgaccctccaacggttgctgtggcaggaaaaaacttgagctctggaaaccgtggctgaccccaggcaacagggaccagttcctccttgtgtggttaccaggacacccccaacaccaggtcctaaccccggatttgtagccccacagccagctttgagattctgtgaatccgtgactcttggatccggcatctaagggacaccaatccatgagggatttggtagtgaaaggcccaagggtccttaaccgactgtggttctttggattcccttacgtgtgtttgtatttgtgaagttcctgtgcatttgctattctgtctcccggtttaaatttattgccagttatcaaagagtgttttgatcgcattggttgttttccgtatgatgattgtgaggtgcaccttacagcaaaaaaagaggccgagccagggactcaggtggcctgagtttcagttctgaccctgccagttaattacagtggaattcagggcaaattacttttctgagcctctgtttcctcacctataggatgggttagcatacttgccttgtggaggagtagtgtccgttgagatcacgtt

SEQ ID NO: 143684 - DNA, 1421 bp, Homo sapiens
  Payload ID: 8388
  Gene Symbol: IFNL4
  Gene Name: interferon, lambda 4 (gene/pseudogene)
  ENST ID: ENST00000634680
  CDS Start-End: 278-602
gttgcccaggtggagacggctctggacgcctcccaggggacagtggacggcagcacctgctgcagcacgaggcacagagggtgcactgcagacaggagtgagggcagaggccaaggcgaggagggggccggctcccactctctctcccactgtgtgtgctgtgccttcacgctccgagcattgccttccctgggatcctaacccaaggcggggggctggacgcgctggaccctctctttggcttccctgacgtctctcgcctgctgcagaagcagagatgcggccgagtgtctgggccgcagtggccgcggggctgtgggtcctgtgcacggtgatcgcagaaggccccccggcgctgcctgctctcgcactaccgctcgctggagccccggacgctggcggctgccaaggcgctgagggaccgctaccttgagctggcacggccaggctcctccaggaaggtccccggggcccagaagaggcgtcacaaaccccggagagcggactcgcctcggtgccgcaaagccagcgtggtcttcaacctcctgcgcctgctcacgtgggagctccggctggctgcacactctgggccttgcctctgaccccgccccctctggcagcacggaaacctccacgccattggctgccgaaagcagctcctgtcgtccattgggctggccgggcgaggctctcagtcaatgggtgctgaggcacgaaaacttcttcgcagccttgggcctgacttggatccactgtctcagatataagaggagcgggtccttctacagggaagagaccacagttctccaggaagccacgatatttcctcggggtgcattgtacgaccctccaacggttgctgtggcaggaaaaaacttgagctctggaaaccgtggctgaccccaggcaacagggaccagttcctccttgtgtggttaccaggacacccccaacaccaggtcctaaccccggatttgtagccccacagccagctttgagattctgtgaatccgtgactcttggatccggcatctaagggacaccaatccatgagggatttggtagtgaaaggcccaagggtccttaaccgactgtggttctttggattcccttacgtgtgtttgtatttgtgaagttcctgtgcatttgctattctgtctcccggtttaaatttattgccagttatcaaagagtgttttgatcgcattggttgttttccgtatgatgattgtgaggtgcaccttacagcaaaaaaagaggccgagccagggactcaggtggcctgagtttcagttctgaccctgccagttaattacagtggaattcagggcaaattacttttctgagcctctgtttcctcacctataggatgggttagcatacttgccttgtggaggagtagtgtccgttgagatcacgtt

SEQ ID NO: 143685 - DNA, 1493 bp, Homo sapiens
  Payload ID: 8388
  Gene Symbol: IFNL4
  Gene Name: interferon, lambda 4 (gene/pseudogene)
  ENST ID: ENST00000634967
  CDS Start-End: 278-674
gttgcccaggtggagacggctctggacgcctcccaggggacagtggacggcagcacctgctgcagcacgaggcacagagggtgcactgcagacaggagtgagggcagaggccaaggcgaggagggggccggctcccactctctctcccactgtgtgtgctgtgccttcacgctccgagcattgccttccctgggatcctaacccaaggcggggggctggacgcgctggaccctctctttggcttccctgacgtctctcgcctgctgcagaagcagagatgcggccgagtgtctgggccgcagtggccgcggggctgtgggtcctgtgcacggtgatcgcagaaggccccccggcgctgcctgctctcgcactaccgctcgctggagccccggacgctggcggctgccaaggcgctgagggaccgctacgaggaagaggcgctgagctgggggcagcgcaactgctccttccgccccaggagggatcctccgcggccatcgcttgagctggcacggccaggctcctccaggaaggtccccggggcccagaagaggcgtcacaaaccccggagagcggactcgcctcggtgccgcaaagccagcgtggtcttcaacctcctgcgcctgctcacgtgggagctccggctggctgcacactctgggccttgcctctgaccccgccccctctggcagcacggaaacctccacgccattggctgccgaaagcagctcctgtcgtccattgggctggccgggcgaggctctcagtcaatgggtgctgaggcacgaaaacttcttcgcagccttgggcctgacttggatccactgtctcagatataagaggagcgggtccttctacagggaagagaccacagttctccaggaagccacgatatttcctcggggtgcattgtacgaccctccaacggttgctgtggcaggaaaaaacttgagctctggaaaccgtggctgaccccaggcaacagggaccagttcctccttgtgtggttaccaggacacccccaacaccaggtcctaaccccggatttgtagccccacagccagctttgagattctgtgaatccgtgactcttggatccggcatctaagggacaccaatccatgagggatttggtagtgaaaggcccaagggtccttaaccgactgtggttctttggattcccttacgtgtgtttgtatttgtgaagttcctgtgcatttgctattctgtctcccggtttaaatttattgccagttatcaaagagtgttttgatcgcattggttgttttccgtatgatgattgtgaggtgcaccttacagcaaaaaaagaggccgagccagggactcaggtggcctgagtttcagttctgaccctgccagttaattacagtggaattcagggcaaattacttttctgagcctctgtttcctcacctataggatgggttagcatacttgccttgtggaggagtagtgtccgttgagatcacgtt

SEQ ID NO: 143686 - DNA, 4549 bp, Homo sapiens
  Payload ID: 8389
  Gene Symbol: IFNLR1
  Gene Name: interferon, lambda receptor 1
  Uniprot ID: Q8IU57
  ENST ID: ENST00000327535
  CDS Start-End: 14-1576
cggcaggaaggccatggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggacttttctggacacacacaccctgtggcaacctttcagcccagcagaccagagtccgtgaatgacttgttcctctgtccccaaaaggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtgagctgtcccccgacatcccaccgaatctgatgctgctgctgcctttgcaaggactactgggcttcccaagaaactcaagagcctccgtacctcccctgggcggcggaggggcattgcacttccgggaagtccacctagcggctgtttgcctgtcgggctgagcaacaagatgcccctccctcctgtgacccgccctctttaggctgagctataagaggggtggacacagggtgggctgaggtcagaggttggtggggtgtcatcacccccattgtccctagggtgacaggccagggggaaaaattatccccggacaacatgaaacaggtgaggtcaggtcactgcggacatcaagggcggacaccaccaaggggccctctggaacttgagaccactggaggcacacctgctatacctcatgcctttcccagcagccactgaactcccccatcccagggctcagcctcctgattcatgggtcccctagttaggcccagataaaaatccagttggctgagggttttggatgggaagggaagggtggctgtcctcaaatcctggtctttggagtcatggcactgtacggttttagtgtcagacagaccggggttcaaatcccagctctgctgttcactggttgtatgatcttggggaagacatcttccttctctgcctcggcttcctcatctgcagctacgcctgggtgtggtgagggttctaggggatctcagatgtgtgtagcacggagcctgctgtgtcctgggtgctctctacgtggtggccggtagaattctccatctatccaggctccaggagacccctgggcatctcccacctgtggcccctaaacccagagtgactgagagcacttaacattcagcttgtctcatccccagtctacctccttccttctaccctcactgcctcccagtcaggagagtgagctctcagaagccagagccccacccaaggggaccctggtctctccgccttcacctagcaatgggaaccctgcttcccaggggaggaaccaactgctccaccttctagggacccagtttgttggagtaggacagtaacatggcaggaatcggacttctgggcctgtaatcccagtttggatggcacgttagactcttggttgaccgttgtggtccttagaagtcccattctcccttccagttatgagaaaccaatgccttctagattcaggtgactatccttacctgggggtgctgatgcatcctcagttaacctacacccacctgaatatagatgagcgtagctgagttttcacccgtaggaccgaagtgttttgtggtggagtatctgaacaaccttggctctgtggccattcaacctgccaggactaacatttctggatttgtgaagaagggatcttcaaagccattgaacccacagagctgtgttgctttaaagccaccacaagggtacagcattaaatggcagaactggaaaagcttcttagggcatctcatccagggattctcaaaccatgtcccccagaggccttgggctgcagttgcagggggcgccatggggctataggagcctcccactttcaccagagcagcctcactgtgccctgattcacacactgtggctttccacgtgaggttttgtttagagggatccactactcaagaaaaagttagcaaaccactccttttgttgcaaaggagctgaggtcaagggtggcaaaggcacttgtccaaggtcgcccagcagtgctgctctgatgacttgtgcacatccccaagggtaagagcttcgatctctgcacagccgggccaacctctgaccccttgtccatgtcagtaaaatatgaaggtcacagccaggatttctaagggtcaggaggccttcaccgctgctggggcacacacacacacatgcatacacacatacgacacacacctgtgtctccccaggggttttccctgcagtgaggcttgtccagatgattgagcccaggagaggaagaacaaacaaactacggagctggggagggctgtggcttggggccagctcccagggaaattcccagacctgtaccgatgttctctctggcaccagccgagctgcttcgtggaggtaacttcaaaaaagtaaaagctatcatcagcatcatcttagacttgtatgaaataaccactccgtttctattcttaaaccttaccatttttgttttgttttgtttttttgagtcggagttttgttctttttgcctaggctggagtgcagtggtacaatctcggctcactgcaacctccacctcccgggttcaagtgattctcctgcctcagcctcccaagtagctgggattacaggcacccgccaccacacctggctaatttttttgtatttttagtagagacggggtttcaccatgttggccaggctggtctcgaactcctgacctcaggtgatccgcccgcctcggcctcccaaagtgctgggattacaggcgtgagccaccgcgcccagccaaaccttactatttttttaaagaattttttccagagtttaatttctgacatagcttaagttttccagtaactctaaactccatctcctttatcgtcattaagtcattcacaaaaagccaggagaagcatttggaaagggcatgataatcagtataataatttgccttgtgtggtcagcacttaactgtttacaaagccctttcacgtgcacagcaggtgggaactgcgcggtgtgggctgggcctgcgctggaagcatatcccgtgaaaagtgttagtgccttaggtgaaagcaacatgtatccctttagactactaacggtatatgttgttcttatgtatttgtatttatttctattttttctatgtttatgtcatatttaaacgatatcctactgcttgttggtattaccctaaactgtttaaataaagagctctatttttaaagaaaaaaggtacaattga

SEQ ID NO: 143687 - DNA, 1476 bp, Homo sapiens
  Payload ID: 8389
  Gene Symbol: IFNLR1
  Gene Name: interferon, lambda receptor 1
  Uniprot ID: Q8IU57
  ENST ID: ENST00000327575
  CDS Start-End: 14-748
cggcaggaaggccatggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccaggacttttctggacacacacaccctgtggcaacctttcagcccagcagaccagagtccgtgaatgacttgttcctctgtccccaaaaggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtgagctgtcccccgacatcccaccgaatctgatg

SEQ ID NO: 143688 - DNA, 674 bp, Homo sapiens
  Payload ID: 8389
  Gene Symbol: IFNLR1
  Gene Name: interferon, lambda receptor 1
  Uniprot ID: Q8IU57
  ENST ID: ENST00000374418
  CDS Start-End: 1-636
atggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaaggtgggaagctcctttcctgcccccaggctaggcccgctcctccaccccttcttactcaggttcttctcaccctcccagcctgctcctgcacccctcctccaggaagtcttccctgtacactcctgacttctggcagtcagccctaataaaatctgatcaaagta

SEQ ID NO: 143689 - DNA, 953 bp, Homo sapiens
  Payload ID: 8389
  Gene Symbol: IFNLR1
  Gene Name: interferon, lambda receptor 1
  ENST ID: ENST00000374419
  CDS Start-End: 350-907
tcctcctaaagggccgcataatattgcgcgtcgtggcgtgtgccttactgggaagctactgctgtccaggtgaacaccacagccttcggggtcagaaagacagctttccccagaacaagcacctgaagctctggggcctgccgctccccgggagagaaggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggtatagcaaatctgggggtgtgcagcaggtggggaggggttgagagtaaggg

SEQ ID NO: 143690 - DNA, 1476 bp, Homo sapiens
  Payload ID: 8389
  Gene Symbol: IFNLR1
  Gene Name: interferon, lambda receptor 1
  Uniprot ID: Q8IU57
  ENST ID: ENST00000374421
  CDS Start-End: 1-1476
atggcggggcccgagcgctggggccccctgctcctgtgcctgctgcaggccgctccagggaggccccgtctggcccctccccagaatgtgacgctgctctcccagaacttcagcgtgtacctgacatggctcccagggcttggcaacccccaggatgtgacctattttgtggcctatcagagctctcccacccgtagacggtggcgcgaagtggaagagtgtgcgggaaccaaggagctgctatgttctatgatgtgcctgaagaaacaggacctgtacaacaagttcaagggacgcgtgcggacggtttctcccagctccaagtccccctgggtggagtccgaatacctggattacctttttgaagtggagccggccccacctgtcctggtgctcacccagacggaggagatcctgagtgccaatgccacgtaccagctgcccccctgcatgcccccactggatctgaagtatgaggtggcattctggaaggagggggccggaaacaagaccctatttccagtcactccccatggccagccagtccagatcactctccagccagctgccagcgaacaccactgcctcagtgccagaaccatctacacgttcagtgtcccgaaatacagcaagttctctaagcccacctgcttcttgctggaggtcccagaagccaactgggctttcctggtgctgccatcgcttctgatactgctgttagtaattgccgcagggggtgtgatctggaagaccctcatggggaacccctggtttcagcgggcaaagatgccacgggccctggaactgaccagaggggtcaggccgacgcctcgagtcagggccccagccacccaacagacaagatggaagaaggaccttgcagaggacgaagaggaggaggatgaggaggacacagaagatggcgtcagcttccagccctacattgaaccaccttctttcctggggcaagagcaccaggctccagggcactcggaggctggtggggtggactcagggaggcccagggctcctctggtcccaagcgaaggctcctctgcttgggattcttcagacagaagctgggccagcactgtggactcctcctgggacagggctgggtcctctggctatttggctgagaaggggccaggccaagggccgggtggggatgggcaccaagaatctctcccaccacctgaattctccaaggactcgggtttcctggaagagctcccagaagataacctctcctcctgggccacctggggcaccttaccaccggagccgaatctggtccctgggggacccccagtttctcttcagacactgaccttctgctgggaaagcagccctgaggaggaagaggaggcgagggaatcagaaattgaggacagcgatgcgggcagctggggggctgagagcacccagaggaccgaggacaggggccggacattggggcattacatggccaggtga

SEQ ID NO: 143691 - DNA, 1932 bp, Homo sapiens
  Payload ID: 8390
  Gene Symbol: IFNW1
  Gene Name: interferon, omega 1
  Uniprot ID: P05000
  ENST ID: ENST00000380229
  CDS Start-End: 576-1163
gatctggtaaacctgaagcaaatatagaaacctatagggcctgacttcctacataaagtaaggagggtaaaaatggaggctagaataagggttaaaattttgcttctagaacagagaaaatgatttttttcatatatatatgaatatatattatatatacacatatatacatatattcactatagtgtgtatacataaatatataatatatatattgttagtgtagtgtgtgtctgattatttacatgcatatagtatatacacttatgactttagtacccagacgtttttcatttgattaagcattcatttgtattgacacagctgaagtttactggagtttagctgaagtctaatgcaaaattaatagattgttgtcatcctcttaaggtcatagggagaacacacaaatgaaaacagtaaaagaaactgaaagtacagagaaatgttcagaaaatgaaaaccatgtgtttcctattaaaagccatgcatacaagcaatgtcttcagaaaacctagggtccaaggttaagccatatcccagctcagtaaagccaggagcatcctcatttcccaatggccctcctgttccctctactggcagccctagtgatgaccagctatagccctgttggatctctgggctgtgatctgcctcagaaccatggcctacttagcaggaacaccttggtgcttctgcaccaaatgaggagaatctcccctttcttgtgtctcaaggacagaagagacttcaggttcccccaggagatggtaaaagggagccagttgcagaaggcccatgtcatgtctgtcctccatgagatgctgcagcagatcttcagcctcttccacacagagcgctcctctgctgcctggaacatgaccctcctagaccaactccacactggacttcatcagcaactgcaacacctggagacctgcttgctgcaggtagtgggagaaggagaatctgctggggcaattagcagccctgcactgaccttgaggaggtacttccagggaatccgtgtctacctgaaagagaagaaatacagcgactgtgcctgggaagttgtcagaatggaaatcatgaaatccttgttcttatcaacaaacatgcaagaaagactgagaagtaaagatagagacctgggctcatcttgaaatgattctcattgattaatttgccatataacacttgcacatgtgactctggtcaattcaaaagactcttatttcggctttaatcacagaattgactgaattagttctgcaaatactttgtcggtatattaagccagtatatgttaaaaagacttaggttcaggggcatcagtccctaagatgttatttatttttactcatttatttattcttacattttatcatatttatactatttatattcttatataacaaatgtttgcctttacattgtattaagataacaaaacatgttcagctttccatttggttaaatattgtattttgttatttattaaattattttcaaacaaaacttcttgaagttatttattcgaaaaccaaaatccaaacactagttttctgaaccaaatcaaggaatggacggtaatatacacttacctattcattcattccatttacataatatgtataaagtgagtatcaaagtggcatattttggaattgatgtcaagcaatgcaggtgtactcattgcatgactgtatcaaaatatctcatgtaaccaataaatatatacacttactatgtacccacaaaaattaaaaagttattttaaaaaagaaatacaggtgaataaacacagtttctttccgtgttgaagagctttcattcttacaggaaaagaaacagtaaagatgtaccaatttcgcttatatgaaacactacaaagataagtaaaagaaaatgatgttctcatactagaagctt

SEQ ID NO: 143692 - DNA, 1241 bp, Homo sapiens
  Payload ID: 8391
  Gene Symbol: IFI35
  Gene Name: interferon-induced protein 35
  Uniprot ID: P80217
  ENST ID: ENST00000415816
  CDS Start-End: 224-1084
ggcagggggcggcatgtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccagatgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaacggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 143693 - DNA, 1232 bp, Homo sapiens
  Payload ID: 8391
  Gene Symbol: IFI35
  Gene Name: interferon-induced protein 35
  Uniprot ID: P80217
  ENST ID: ENST00000438323
  CDS Start-End: 209-1075
gtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaagtggctgagcaggtgctgcaacaaaaggagcacacgatcaacatggaggagtgccggctgcgggtgcaggtccagcccttggagctgcccatggtcaccaccatccaggtgatgatgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggagtggctcagcgtctgtgccaaatcggccagttcacagtgccactgggtgggcagcaagtccctctgagagtctctccgtatgtgaacggggagatccagaaggctgagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgcca

SEQ ID NO: 143694 - DNA, 1687 bp, Homo sapiens
  Payload ID: 8392
  Gene Symbol: IFI44
  Gene Name: interferon-induced protein 44
  Uniprot ID: Q8TCB0
  ENST ID: ENST00000370747
  CDS Start-End: 86-1420
cattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaactaatttccagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttctcctctcagatgatagtaaagatcaaaagaattcgaagggagttggtaaacgctggtgtggtacatgtggctttgctcactcatgtggatagcatggatttgattacaaaaggtgaccttatagaaatagagagatgtgagcctgtgaggtccaagctagaggaagtccaaagaaaacttggatttgctctttctgacatctcggtggttagcaattattcctctgagtgggagctggaccctgtaaaggatgttctaattctttctgctctgagacgaatgctatgggctgcagatgacttcttagaggatttgccttttgagcaaatagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggtctaa

SEQ ID NO: 143695 - DNA, 686 bp, Homo sapiens
  Payload ID: 8392
  Gene Symbol: IFI44
  Gene Name: interferon-induced protein 44
  ENST ID: ENST00000438486
  CDS Start-End: 102-686
attttgtgcctgcctagctatccagacagagcagctaccctcagctctagctgatactacagacagtacaacagatagatggaagaaatagaaaagtgattatggacttaaagacaatggaaaatcttggacttgctcaaaattgtactatctctattcaggattatgaagtttttcgatgcgaagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctgtgtgactcactggggctgagtgagaaagaaggcggcctgtgcagggatgacatattctatatcttgaacggtaacattcgtgatagataccagtttaatcccatggaatcaatcaaattaaatcatcatgactacattgattccccatcgctgaaggacagaattcattgtgtggcatttgtatttgatgccagctctattcaatacttc

SEQ ID NO: 143696 - DNA, 497 bp, Homo sapiens
  Payload ID: 8392
  Gene Symbol: IFI44
  Gene Name: interferon-induced protein 44
  ENST ID: ENST00000446486
  CDS Start-End: 1-230
ctctttctgacatctcggtggttagcaattattcctctgagtgggagctggaccctgtaaaggatgttctaattctttctgctctgagacgaatgctatgggctgcagatgacttcttagaggatttgccttttgagcaaataggtagatggtttggtggtgtggaagcttggaagcggtcagggaatctaagggaggaaattatcaactgtgcacaaggaaaaaaatagatatgtgaaaggttcacgtaaatttcctcacatcacagaagattaaaattcagaaaggagaaaacacagaccaaagagaagtatctaagaccaaagggatgtgttttattaatgtctaggatgaagaaatgcatagaacattgtagtacttgtaaataactagaaataacatgatttagtcataattgtgaaaaataataataatttttcttggatttatgttctgtatctgtgaaaaaataaatttcttataaaactcgggtctaa

SEQ ID NO: 143697 - DNA, 5874 bp, Homo sapiens
  Payload ID: 8393
  Gene Symbol: IFI44L
  Gene Name: interferon-induced protein 44-like
  Uniprot ID: Q53G44
  ENST ID: ENST00000370751
  CDS Start-End: 180-1538
gctgccagctgagtttttttgctgctttgagtctcagttttctttctttcctagagtctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacatgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggtataggatatattctgttaaagatggaaaaaatggaaaatctctgccatttatgttgtgtgacactatggggctagatggggcagaaggagcaggactgtgcatggatgacattccccacatcttaaaaggttgtatgccagacagatatcagtttaattcccgtaaaccaattacacctgagcattctacttttatcacctctccatctctgaaggacaggattcactgtgtggcttatgtcttagacatcaactctattgacaatctctactctaaaatgttggcaaaagtgaagcaagttcacaaagaagtattaaactgtggtatagcatatgtggccttgcttactaaagtggatgattgcagtgaggttcttcaagacaactttttaaacatgagtagatctatgacttctcaaagccgggtcatgaatgtccataaaatgctaggcattcctatttccaatattttgatggttggaaattatgcttcagatttggaactggaccccatgaaggatattctcatcctctctgcactgaggcagatgctgcgggctgcagatgattttttagaagatttgcctcttgaggaaactggtgcaattgagagagcgttacagccctgcatttgagataagttgccttgattctgacatttggcccagcctgtactggtgtgccgcaatgagagtcaatctctattgacagcctgcttcagattttgcttttgttcgttttgccttctgtccttggaacagtcatatctcaagttcaaaggccaaaacctgagaagcggtgggctaagataggtcctactgcaaaccacccctccatatttccgtaccatttacaattcagtttctgtgacatctttttaaaccactggaggaaaaatgagatattctctaatttattcttctataacactctatatagagctatgtgagtactaatcacattgaataatagttataaaattattgtatagacatctgcttcttaaacagattgtgagttctttgagaaacagcgtggattttacttatctgtgtattcacagagcttagcacagtgcctggtaatgagcaagcatacttgccattacttttccttcccactctctccaacatcacattcactttaaatttttctgtatatagaaaggaaaactagcctgggcaacatgatgaaaccccatctccactgcaaaaaaaaaaaaaaaaaataagaaagaacaaaacaaaccccacaaaaattagctgggtatgatggcacgtgcctgtagtcccagttactcaggatgattgattgagccttggaggtggaggctacagtgagctgagattgtgccactgtactctagccagggagaaagagtgagatcctggctcaaaaaaaccaaataaaacaaaacaaacaaacgaaaaacagaaaggaagactgaaagagaatgaaaagctggggagaggaaataaaaataaagaaggaagagtgtttcatttatatctgaatgaaaatatgaatgactctaagtaattgaattaattaaaatgagccaacttttttttaacaatttacattttatttctatgggaaaaaataaatattcctcttctaacaaacccatgcttgattttcattaattgaattccaaatcatcctagccatgtgtccttccatttaggttactggggcaaatcagtaagaaagttcttatatttatgctccaaataattctgaagtcctcttactagctgtgaaagctagtactattaagaaagaaaacaaaattcccaaaagatagctttcacttttttttttccttaaagacttcctaattctcttctccaaattcttagtcttcttcaaaataatatgctttggttcaatagttatccacattctgacagtctaatttagttttaatcagaattatactcatcttttgggtagtcatagatattaagaaagcaagagtttcttatgtccagttatggaatatttcctaaagcaaggctgcaggtgaagttgtgctcaagtgaatgttcaggagacacaattcagtggaagaaattaagtctttaaaaaagacctaggaataggagaaccatggaaattgaggaggtaggcctacaagtagatattgggaacaaaattagagaggcaaccagaaaaagttattttaggctcaccagagttgttcttattgcacagtaacacaccaatataccaaaacagcaggtattgcagtagagaaagagtttaataattgaatggcagaaaaatgaggaaggttgaggaaacctcaaatctacctccctgctgagtctaagtttaggatttttaagagaaaggcaggtaaggtgctgaaggtctggagctgctgatttgttggggtatagggaatgaaatgaaacatacagagatgaaaactggaagtttttttttgtttgttttgttttttttttgttgttgtttttttttttttttgtttttttgctgagtcaattccttggagggggtcttcagactgactggtgtcagcagacccatgggattccaagatctggaaaactttttagatagaaacttgatgtttcttaacgttacatatattatcttatagaaataactaagggaagttagtgccttgtgaccacatctatgtgacttttaggcagtaagaaactataaggaaaggagctaacagtcatgctgtaagtagctacagggaattggcttaaagggcaagttggttagtacttagctgtgtttttattcaaagtctacattttatgtagtggttaatgtttgctgttcattaggatggtttcacagttaccatacaaatgtagaagcaacaggtccaaaaagtagggcatgattttctccatgtaatccagggagaaaacaagccatgaccattgttggttgggagactgaaggtgattgaaggttcaccatcatcctcaccaacttttgggccataattcacccaaccctttggtggagcctgaaaaaaatctgggcagaatgtaggacttctttattttgtttaaaggggtaacacagagtgcccttatgaaggagttggagatcctgcaaggaagagaaggagtgaaggagagatcaagagagagaaacaatgaggaacatttcatttgacccaacatcctttaggagcataaatgttgacactaagttatcccttttgtgctaaaatggacagtattggcaaaatgataccacaacttcttattctctggctctatattgctttggaaacacttaaacatcaaatggagttaaatacatatttgaaatttaggttaggaaatattggtgaggaggcctcaaaaagggggaaacatcttttgtctgggaggatattttccattttgtggatttccctgatctttttctaccaccctgaggggtggtgggaattatcattttgctacattttagaggtcatccaggatttttgaaactttacattctttacggttaagcaagatgtacagctcagtcaaagacactaaattcttcttagaaaaatagtgctaaggagtatagcagatgacctatatgtgtgttggctgggagaatatcatcttaaagtgagagtgatgttgtggagacagttgaaatgtcaatgctagagcctctgtggtgtgaatgggcacgttaggttgttgcattagaaagtgactgtttctgacagaaatttgtagctttgtgcaaactcacccaccatctacctcaataaaatatagagaaaagaaaaatagagcagtttgagttctatgaggtatgcaggcccagagagacataagtatgttcctttagtcttgcttcctgtgtgccacactgcccctccacaaccatagctgggggcaattgtttaaagtcattttgttcccgactagctgccttgcacattatcttcattttcctggaatttgatacagagagcaatttatagccaattgatagcttatgctgtttcaatgtaaattcgtggtaaataacttaggaactgcctcttctttttctttgaaaacctacttataactgttgctaataagaatgtgtattgttcaggacaacttgtctccatacagttgggttgtaaccctcatgcttggcccaaataaactctctacttatatcagtttttcctacacttcttccttttaggtcaacaataccaagaggggttactgtgctgggtaatgtgtaaacttgtgtcttgtttagaaagataaatttaaagactatcacattgctttttcataaaacaagacaggtctacaattaatttattttgacgcaaattgataggggggccaagtaagccccatatgcttaatgatcagctgatgaataatcatctcctagcaacataactcaatctaatgctaaggtacccacaagatggcaaggctgatcaaagtcgtcatggaatcctgcaaccaaaagccatgggaatttggaagccctcaaatcccattcctaatctgatgagtctatggaccaatttgtggaggacagtagattaaatagatctgatttttgccatcaatgtaaggaggataaaaacttgcataccaattgtacacccttgcaaaatctttctctgatgttggagaaaatgggccagtgagatcatggatatagaagtacagtcaatgttcagctgtaccctcccacaatcccacttccttcctcaacacaattcaaacaaatagactcagactgtttcaggctccaggacaggaagtgcagtgtaggcaaaattgcaaaaattgagggcacaggggtggaggtgggggggttgaataacaagctgtgctaaataattacgtgtaaatatattttttcatttttaaaaattgatttcttttgcacattccatgacaatatatgtcacatttttaaaataaatgcaaagaagcatacatccaa

SEQ ID NO: 143698 - DNA, 849 bp, Homo sapiens
  Payload ID: 8393
  Gene Symbol: IFI44L
  Gene Name: interferon-induced protein 44-like
  ENST ID: ENST00000450498
  CDS Start-End: 1-699
ttgagtcttctctataagtctagtgttcatggaggtagcattgaagatatggttgaaagatgcagccgtcagggatgtactataacaatggcttacattgattacaatatgattgtagcctttatgcttggaaattatattaatttacatgaaagttctacagagccaaatgattccctatggttttcacttcaaaagaaaaatgacaccactgaaatagaaactttactcttaaatacagcaccaaaaattattgatgagcaactggtgtgtcgtttatcgaaaacggatattttcattatatgtcgagataataaaatttatctagataaaatgataacaagaaacttgaaactaaggttttatggccaccgtcagtatttggaatgtgaagtttttcgagttgaaggaattaaggataacctagacgacataaagaggataattaaagccagagagcacagaaataggcttctagcagacatcagagactataggccctatgcagacttggtttcagaaattcgtattcttttggtgggtccagttgggtctggaaagtccagttttttcaattcagtcaagtctatttttcatggccatgtgactggccaagccgtagtggggtctgatatcaccagcataaccgagcggggcaatcctaatatacaattaaatgctaaatcaaatggaaaataggagtaaaattttgatcagaaccacctccattgtgctatattatacagagaagctttcaaattttatggatggaagaagcagttatataaagaatactttttagtatttgtataaaaaacaacaaaaaattaaaaaccctatgaaaatctt

SEQ ID NO: 143699 - DNA, 554 bp, Homo sapiens
  Payload ID: 8393
  Gene Symbol: IFI44L
  Gene Name: interferon-induced protein 44-like
  ENST ID: ENST00000452835
  CDS Start-End: 263-554
cagtgcagacaggcttggctttgaacagcatccagctccacgattctatcagctaaattttttttttgtactttaagaaatagggatagtcatagtgtttactgtacgcagttgttctgaggagaaattaggaaaagagtctctgaagccacagatctcttaagaactttctgtctccaaaccgtggctgctcgataaatcagacagaacagttaatcctcaatttaagcctgatctaacccctagaaacagatatagaacaatggaagtgacaacaagattgacatggaatgatgaaaatcatctgcgcaagctgcttggaaatgtttctttgagtcttctctataagtctagtgttcatggaggtagcattgaagatatggttgaaagatgcagccgtcagggatgtactataacaatggcttacattgattacaatatgattgtagcctttatgcttggaaattatattaatttacatgaaagttctacagagccaaatgattccctatggttttcacttcaaaagaaaaatgacaccactgaaatagaaa

SEQ ID NO: 143700 - DNA, 1880 bp, Homo sapiens
  Payload ID: 8394
  Gene Symbol: IFIT1
  Gene Name: interferon-induced protein with tetratricopeptide repeats 1
  Uniprot ID: P09914
  ENST ID: ENST00000371804
  CDS Start-End: 168-1604
gcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaaaaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttacactaaa

SEQ ID NO: 143701 - DNA, 4613 bp, Homo sapiens
  Payload ID: 8394
  Gene Symbol: IFIT1
  Gene Name: interferon-induced protein with tetratricopeptide repeats 1
  Uniprot ID: P09914
  ENST ID: ENST00000546318
  CDS Start-End: 496-1839
gcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgaggttctttaccacagagaaaaagcaggacccacaagaatgtgaaagcctcagtcttgcagcctctctgatgtcttgtgggtaatacagtggagatgtggtaggaaaagctcacagccttcctccataggcttctggtctcactttctgcactgctggcctcttacaacaggttttcgcaatcaggctgagcttaagataaacagattgcctcctccctggaaaatctaggctcttgtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaaaaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttacactaaatgtttaattcattcattttattgtgaaataaaaataaaatccttagctcctccaccaactgaacagaccctcttggccaaggagaccccagaaaccttaaaaactaagtttcccaaccatgacaagatgagagatcattcacacctcattatattccctcccttgctaactgccattggactttttccactgagttaaacagaaacccatggaaaacaaagaacagaagactcactccttggctgacttcacctagctcactccacgtagcgccacagccagactcccctcccctcttgcggtttccacatgacaactgatcagccttccctcctgataagtgaccactgcccacagactggttctggccagtccatggaggctgcacacagggtgcctctatgtcctttgtttcaccttttgatatagaaaggctaattttgctgtattttaatgttaagtctccaccacagagtgaacacagaatgcatgtgacatacatgtttacataccactattgtgtgactgcccctcatgaatattcatagccccccataacctgttaactatgtgtgtctagccaatccaccaaccataaaacttctgtaataccctcccttcctccaagagcctgcttttggttgctgtggtaggctctgcttcccaggctgcaggttgcaggagaggaggctgcagtggctcacgcctgtaatctcagcacttcgatgggacgaggcaggcagatcacctgaacccaggagttcgagagcagccttggcaatggcaaaaccaaccgtctctacaaaaaatgcaaaaacttagctgggtgtggtggcatgcacctgtagcttcagttccagctactcaggaggctgaggtgagtggactgctggagccagggagttcgaggctgcagtgtcgagatcttgccactgcactccattctggatgatagaacgagaccccatctcaaaaaaaaaaaaagttctctccaattgtatatagcttgtgattttatgtcaacactatcaataaatagctttcagtgcaagaaaccaaaaatactgtaataaacaggcacatattcttcccaaacctcatgcagtttacaatctagtgagagacacagatagcagtacagagtcaattaaaggttagttttcttcatgaagatgttttaattttaattcaatgtgaaagggttccaaggagtttatcttgttttatgccattttatttgaagcactacttactaagtcatttgctgatattaatctagttaaatcaagaaatattacatgaaaatgttgctaaatcagagatcatgggtaacaatcacctttgattatgaataatcatattttattgaaaggcaaggcacaacaaataataagaaggaaaaaataaataagcaatgttattgatctttcattctgtatatgttttggggggaatatactagtttcttttagtggctgtaacaaattaccacaaacttggtgacttaaaatttcacagatttactctttcttacagttctggaggtcagaagtctgaaatgggtttcaatgagccaaagtcaaggtattgatgacgctacactcctccggaggctctaggcagatagccttttccagcttccagaggctgcctgaattctttcatccatcttaaaaaccaacagtgtagtagcctcaaatctctctctctgcttccttcttcacatctccttctctcctctgactcttttgcctctttcttctaaggacgcaccaggtccacctgcataatccagaataattgccccatccgcaaatccttaatttaataacatctgcaaagtcccttttgctatgtaaagtagcatgttcacaggttctggagacttggccatggatacgattgcggggggggcattattcttaccacagagcaccccaagaaaatctccaaattttgggcttccaatccattttgcttcaattatttaatatttttactccttccagtagatactgatttcatccattgcccttaagaaggtaggacagagattatggcacatctcacattaaatgctatattttcgttggaaatacattttttgcttcaacttttattttaaattcaagggtacatgtgcaggatgttcaggtttgttacacaggtaaacgtgtgccatggcggtttgctgaacagatcatcccatcaccaacagatcatcccattgagaggtgaagccggctgggcttctgggttgggtggggacttggagaacttttctgtctagctaaagtattgtaaaatggaccagtcaacactctgtaaaatggaccaatcagctctctgtaaaatggaccaatcagcaggatgtgggtggggccaagtaagggaataaaagcaggccacccgagctggcagcggcaacccgctcgggtccccttccatgctgtggaagttttgttctttcgctctttcaataaatcttgctgctgctc

SEQ ID NO: 143702 - DNA, 1972 bp, Homo sapiens
  Payload ID: 8395
  Gene Symbol: IFIT1B
  Gene Name: interferon-induced protein with tetratricopeptide repeats 1B
  Uniprot ID: Q5T764
  ENST ID: ENST00000371809
  CDS Start-End: 81-1505
agaactctgtggatgaaccttgaaggagcctccaagcctgaaccaaagcactacagatcacctgctatcttcatagcaccatgagtgaagaatctgatggaaagcttattgaagacagcctgattcagctgagatgtcactttacatggaagttgttaattgaagcccctgaaattcctgatttagaaaacaggatctgggaagagattcagttcctggacaccaaatacaatgtgggaatacacaacctactagcctatgtgaaacacctgaaaggccagaatgaggaagccctggtcagcttgaaaaaggctgaagacttaattcagaaagaacatgccaaccaagcagatattagaagtctggtgacctggggcaactttgcctgggtgtattaccacatgggcagattggcagaagcccagacttacctggacaaggtggagaacacttgcaagaagtttgcaaatccttcccgctatagaatggagtgtccagaggtggactgtgaggaaggatgggccttggcgaagtgtggtggaaagaattatgaacgggccaagacctgctttgaaaaggctctggaagggaaccctgaaaaccctgaattcaatactgggtacgcaatcaccgtctatcgcctggataaatttaacacagcatcagggaggaataaggcattttctctgcacgtcctaaaacgagctgtcaggctaaatccagatgatgtatatattagggttctccttgccctgaagcttcaggatgaaggacaggaagctgaaggagaaaagtacattgaagaagctctgaccagtatatcttcacaggcctatgtctttcaatatgcagccaagttttatcgaagaaaagggtctgtggataaagctcttgagctcttaaaaatggccttggagacaacacccacttctgccttcctgcatcaccaaatggggctttgctacagggcacaaatgatccaaatcaaggaagctacaaactggcagcctagagggcaagatagggaaactgtggacagattggttcaattggctatatgcaaatttgaaaagactataatgttaaagcgaacatttgagatggcctatgttgacctggctgaaacgtatgcagaaataggccaccacagaaaggctgaggaacattttcagaaagggttacgcatgaagatctttgaagatcagctaaagcaagagattcattaccactacggccgtttccaagaacatcatgggaaatctcaagataaagcaattacccattatttaaaaggtttgaaaatagaaaaaatgtcccattccagggaaaaacttctcaatgctttagagaaattggctaaaagatgtattcaccagaatgtacgggttgtggaaagtgtcagcctccttgggcttatccacaaattgaaaggagaagtaagtgatgctttgctgtgctatgagagggctctgaggctggctgctgacctgaaccctatattttaacatagaggtcaccattatccatttaatggtcttataactaaatagaatgactatgaaattaaataatgcaaacttaaagctgttggaaatttaccttattttgagccttgagaggaatgtggctgtgtggcctgagttatgtagcatgcaactgcaacttctgctttttcctgtaaatgatcaggaaaggccttgtggcaccagacataagaccccctgaaagtatcatccctcctgatggaatggtaaagcaatctttcttggaacatagcaagtagtaaccgatcaaattgctataacgtgtgtactgaccttatgtggaaaatgctgcaaccctgtttactgcctatgtaagtgaaatcttaacttccccattttggaatgctgactccagtcattaggtgtctgtatttcctgagtggttaccctcaagctttgtgctcaaataaactctatacttaatcata

SEQ ID NO: 143703 - DNA, 3489 bp, Homo sapiens
  Payload ID: 8396
  Gene Symbol: IFIT2
  Gene Name: interferon-induced protein with tetratricopeptide repeats 2
  Uniprot ID: P09913
  ENST ID: ENST00000371826
  CDS Start-End: 170-1588
actttcccttttgtaacgtcagctgaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgttcttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagacgcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggcggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacataaagcagtgttctggttcatctggaattttgctgtactttaaatctttcagactcagctactgataaatgaaacgttacacaggtgtgaaccaaatccaaataacctcgactggtctactatcataatcacctgaacagaacaaaactttttcctcagctttaagagtccagggcttcggataacagctgccatctgccacctgctaccattgacctacgtgaacacagacattctgtctccaccttgatggtgggtgggctgctccccttttctttgttaaattttgtgctttcatcacattttctctattctgacctctgttatgagaaataaaagtcactgattccatttta

SEQ ID NO: 143704 - DNA, 3038 bp, Homo sapiens
  Payload ID: 8396
  Gene Symbol: IFIT2
  Gene Name: interferon-induced protein with tetratricopeptide repeats 2
  ENST ID: ENST00000611722
  CDS Start-End: 79-1530
ggcagaagaggaagatttctgaagagtgcagctgcctgaaccgagccctgccgaacagctgagaattgcactgcaaccatgagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgttcttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagacgcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggcggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaac

SEQ ID NO: 143705 - DNA, 2455 bp, Homo sapiens
  Payload ID: 8397
  Gene Symbol: IFIT3
  Gene Name: interferon-induced protein with tetratricopeptide repeats 3
  Uniprot ID: O14879
  ENST ID: ENST00000371811
  CDS Start-End: 140-1612
tttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggacgataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaa

SEQ ID NO: 143706 - DNA, 2496 bp, Homo sapiens
  Payload ID: 8397
  Gene Symbol: IFIT3
  Gene Name: interferon-induced protein with tetratricopeptide repeats 3
  Uniprot ID: O14879
  ENST ID: ENST00000371818
  CDS Start-End: 181-1653
cttccttcccctaaaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggacgataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaa

SEQ ID NO: 143707 - DNA, 4015 bp, Homo sapiens
  Payload ID: 8398
  Gene Symbol: IFIT5
  Gene Name: interferon-induced protein with tetratricopeptide repeats 5
  Uniprot ID: Q13325
  ENST ID: ENST00000371795
  CDS Start-End: 214-1662
atctgattcaatctccagtttcctgttcttgctggggctggggtctctcctttaacaaagacacgccgcgcggccgagtccaggggctgcagaggcctggcgcgcgcacgcgcacgcgcacgcccaccgcgcggcttcccgcggtccccggtgctgaggagagagcgatccgagggactgcgccgcccggacggcctgcagagcgctgccatcatgagtgaaattcgtaaggacaccttgaaggccattctgttggagttagaatgtcattttacatggaatttacttaaggaagacattgatctgtttgaggtagaagatacaattgggcaacagcttgaatttcttaccacaaaatctagacttgctctttataacctattggcctatgtgaaacacctaaaaggccaaaataaagacgcccttgagtgcttggaacaagcagaagaaataatccagcaagaacactcagacaaagaagaagtacgaagcctggtcacttggggaaactatgcctgggtgtattatcacatggaccagcttgaagaagctcagaagtatacaggtaagatagggaatgtctgtaagaaattgtccagtccttctaactacaagttggagtgtcctgagactgactgtgagaaaggctgggcactcttgaaatttggaggaaagtattatcaaaaggctaaagcggcttttgagaaggctctggaagtggagcctgacaatccagaatttaacatcggctatgctatcacagtgtatcggctggatgattctgatagagaagggtctgtaaagagcttttctctggggcctttgagaaaggctgttaccctgaacccagataacagctatattaaggtttttctggcactgaagcttcaagatgtacatgcagaagctgaaggggaaaagtatattgaagaaatcctggaccaaatatcatcccagccttacgtccttcgttatgcagccaagttctataggagaaaaaattcctggaacaaagctctcgaacttttaaaaaaggccttggaggtgacaccaacttcttctttcctgcatcaccagatgggactttgctacagggcacaaatgatccaaatcaagaaggccacacacaacagacctaaaggaaaggataaactaaaggttgatgagctgatttcatctgctatatttcatttcaaagcagccatggaacgagactctatgtttgcatttgcctacacagacctggccaacatgtacgctgaaggaggccagtatagcaatgctgaggacattttccggaaagctcttcgtctggagaacataaccgatgatcacaaacatcagatccattaccactatggccgctttcaggaatttcaccgtaaatcagaaaatactgccatccatcattatttagaagccttaaaggtcaaagacagatcaccccttcgcaccaaactgacaagtgctctgaagaaattgtctaccaagagactttgtcacaatgctttagatgtgcagagtttaagtgccctagggtttgtttacaagctggaaggagaaaagaggcaagctgctgagtactatgagaaggcacaaaagatagatccagaaaatgcagaattcctgactgctctctgtgagctccgactttccatttaaatacatactctaggaaattagctctaagtttttcccttcattttgggttctcctgtttgttttttttttattattttaatcccttgtttattatagagctaatatttattgaatagttattgtgtaccaagcattgtgctaaatactttatatgcattatgatgaatcttgtgcggttttctttctttttttctttttaattaaaatactataatccattgagaaatagcaatattctagctattgtaacttctaaaaatggtatggccattagatctgtgctttttatctctgctctttgaatttctcatattatatagtaaatatattcctacgtaaacctttgatacctagatcaggaatactcttccaggagtacaaaattacattattgatagttaagctcttaattgtgtagcttgcaaaagacagcactttttagttacagatgttttgactttgatgaggatatttagctatcaatctaatagtcacctaaaatatcttttttgttggaaaaaagtttataataaaaaagtttgtcatctctagtgacttcaataaagaaaaaactagaagaggagaaaaaggatttcctcaaattttaaatatgtaacttcagggattcaatccccaaatgtttattaagtagctagaaataattatgtggaaaaaaatgaataatggaaaatagtgagtctcaaattgttctctttttttttttaactaaaacaaatctgcaatgaatctagatgcaattaattttattccttccaactaaaattacaatatttttaggttaaaattattgagatataaagcagccattgggaaattgggagaaatgataaacaaatggaaaaagaagatgtccctaacctacacccatagattaccaaggtttcagtgtactagttttgaatctgttctgaatggagtttttataccctcaatttctggcctttggctattttagcatttcaaagtgacttctatgaagctttttttttaatgtgaaattttcagaatgttgtttttttcatgtagatactccaggaagagttaagcactgctttcagttttaatatccaccttgaggggtcgctgcttgagggctcttatcccaggggactttttaattcggatgttacttaatgtggcttctctaatgtagtttctttgattaccgactacacaattatgtaccatcacagtattagtggaaaagtaccatgtgatttaattctccattcctccaatgtaactcttaaaattattatgtatgtgtgtgtgttttactttttgttttttatcatctttaaaatttctattatggtttgattattataaaaataatgaattctcactgtaaatttcaaaaaaaaattacaaaagtatgtgaatttaaaaatgagagcagtcctctcaccctaccacagttccacaccctcaaggtaaacttataacttataatttgatatgtaaacttccagatcttttttctatgcgtaatcagacatacatatatactgcagtgtatctcacgtattaatttttaaaaatcttttgttttacttaattctgtttttattattattattattttgtttgatctattaaggaagaacaaggaagggaatgatctttactcaagaatttcagaaagtcagcactgaagtcctgacctatcagtagacacatttgtccctttcagatattttaggatattctagcaaagcaggccatttctcccacctgaaagtacataacttctatcacttgccacataattaaaagaactcacattaagcggttactcagacagttaatcatagaaaagattatttgcttcatcagttcatagaaaagattatttgcttcatcagttaacttgtttttataaatcagggctgtgttcatacacagaaggggcctgagatttctgcactttaaacaagctcctcctaggtgaggatgctgtggctgttctaattacattttgagtagtaaggtctacagcattgttcctcaaacttggctacgtattggaatcacctaaaaagttaaaacaaaacatggatgtctgggtcccgccccatagagaatgacttaattggcatggggtgcagtccaggcatcatgatttttagatttcccagttggaacttgtgcagcaaagtttgggagctactgatggacatgtgaaaagtaagtataaatggaataaaattaattaggctaataggcttaacccaggaaatcctaagttccttgaatatccagtttgcatttggactcctcatcatatacttggtatataatactctaataaaagctgcctgagttgaattgt

SEQ ID NO: 143708 - DNA, 1834 bp, Homo sapiens
  Payload ID: 8399
  Gene Symbol: IFRD1
  Gene Name: interferon-related developmental regulator 1
  Uniprot ID: O00458
  ENST ID: ENST00000005558
  CDS Start-End: 471-1826
gttaaaaccagactgcactccttctggctcctggttcattcaaggtctacatagttaaaggttgttccagagggatgtgtgtaattcctcccagtatttgatgttcctttattacttattttcacttgagccaacagcctgaactggtcaggctttgggctgatgccagctgctttatctggtagcactgttacataaaattaacatttattggtgatcactaggtgccaacattatgcgaagaactttacgtggacatcccatttaattctcagaagccgatcacaagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcag

SEQ ID NO: 143709 - DNA, 2290 bp, Homo sapiens
  Payload ID: 8399
  Gene Symbol: IFRD1
  Gene Name: interferon-related developmental regulator 1
  Uniprot ID: O00458
  ENST ID: ENST00000403825
  CDS Start-End: 262-1617
gctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaa

SEQ ID NO: 143710 - DNA, 574 bp, Homo sapiens
  Payload ID: 8399
  Gene Symbol: IFRD1
  Gene Name: interferon-related developmental regulator 1
  ENST ID: ENST00000432734
  CDS Start-End: 483-574
agctgtaaatgggtcaggagaccagagtggacagagtaggccctggaatgcttgctcggaggcctgccatgaaggatttctgcttgcttccccaccctaccccgggggcaggatgactcagcacttcctattgttgtgaaggccaaccccaggaggccctaccaaggctgactgctgttaaaaccagactgcactccttctggctcctggttcattcaaggtctacatagttaaaggtgccaacattatgcgaagaactttacgtggacatcccatttaattctcagaagccgatcacaagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagc

SEQ ID NO: 143711 - DNA, 1938 bp, Homo sapiens
  Payload ID: 8399
  Gene Symbol: IFRD1
  Gene Name: interferon-related developmental regulator 1
  ENST ID: ENST00000429071
  CDS Start-End: 232-678
ccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaatgcccttatttttgagtcacagacgtacaactaataaggagtgtgttatcttcttttcagtaacatttagtaatagcactggaacactggcccactcttaaaattttctaatagtcaaggagtgcaccatcttgttatggctcaaaatgagacttgttagaactttgtttttgtattacgtaaaccaaaaaaaaatagcttgaaactaagaaggattagggtagattgtcatcaaccttttttgtatcagaagaggtgatggtcattctcttgttataccagaaaagcttgaaagtgtgtgtcagacatctagctcattttcccttgcacttatataaaacattgattgtacctgtaaattacatcattttcaggatatcccttggaatacttgaattctagaactttgtaatagaaattctggaattcaaattgttacagtgatagaacttttaagaccaaagagaaatcttaaagataattttatcagaccttaaagtccagtgttagtaggcttactagatttaggaaccaccaaatttaaaaagacttgtgactcggcatggtggttcacatctgtaattgtggcactttgggagaccgaggtgggaggattgctggaagccaggagttggagaccacctgggcaacaaagcgatacttggtttctattataacaaacaaaacaaaacgagatttggtgtctgccaacttattcagccaagtaagaacattatgaaaataattatcctccactatcattattttattagcaaaatattatagcaccaaaaatgtagaaatgcacttttaaaaaattgaatgaactaataagctttatatccttatttttctcattttacctgagagtaaaaattttgttgtaagtgaaacctttgatcaaattcactcttccattgaatagaataaagaaaggcctaggaaaactgaggtgggtctaagctgatatatcttgttattggtatagttgatagcagacccaactttttaaagataacacaatggcgctattaaaggtgttttacattcaaactatatgctataatggttgttggactagatgacctttaaaaattccattttagtttgcgtattttttacatttttaatttatcaggtaataatttaagctcagtatttgccccacacttgtggtgtatacagttctcaagagttaatttatatgtacctttatataaatgtattttttgtaccactgcattccagcttgggcgacagagtgagaccctgtctcaaaaaaaaaaaaaaataa

SEQ ID NO: 143712 - DNA, 440 bp, Homo sapiens
  Payload ID: 8399
  Gene Symbol: IFRD1
  Gene Name: interferon-related developmental regulator 1
  ENST ID: ENST00000443101
  CDS Start-End: 320-440
tagccaggggctgtcttcaatttcacagactatgtcatgaaactgtcatgttaaacatttatttttctagctgaatgtcatctttaagggatattatttcactggagaatttgctgagaggagactgacttggattttatcagtccaaaactgagccagaggaatctgctacaggcaatcaggagccagtgaggagttataagccaagcagtaacctgatgattcaatcaaaaaatatgtatggagtgtctcctacttttcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaa

SEQ ID NO: 143713 - DNA, 891 bp, Homo sapiens
  Payload ID: 8399
  Gene Symbol: IFRD1
  Gene Name: interferon-related developmental regulator 1
  ENST ID: ENST00000440625
  CDS Start-End: 511-891
tttgaatgctctccatgttgatgaaattcattctttatcaagatgtaaaatatgtaatttattgtggcctctggttgctctatgtgaattgaggatactttttttttttttgttaagggaaagagggagtctggctctgtcgcccaggctggagtgcggtgtggtgtgatcatagctcactgcaacctcttaactcctgggctcaagcagctctccctcctcagcctcctgtagctaggactacaggcatgtgacaccattcctggctattttttacattttttgtggagacaaggtctatgttggccaggctggtcacgagtccctcgtccccagggatcttcctgcctaagcctcccacaatgctgggacggtgcctggtctgaggatatttcttaccactgtgtttcagcttttcctcatctgaatcaaacatttgaattctttctagaaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatt

SEQ ID NO: 143714 - DNA, 570 bp, Homo sapiens
  Payload ID: 8399
  Gene Symbol: IFRD1
  Gene Name: interferon-related developmental regulator 1
  ENST ID: ENST00000445335
  CDS Start-End: 384-570
atagctgccagctggaagccgactctcgtcatagggcatactcgccccactgtgcatcgccggtgcctacctcacccagttccaaggcgggggcgcgccgaggcaggggtggggtcaccaggagaaaagcaagtgggcagaaaagcccgttgggaagagacggctgggaggaggccccggccccagccttactacgtttcccagaattcagtgaggccacgaagacaggctccctgggcgcggacggaagactggccgcatgggatttgtagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagtt

SEQ ID NO: 143715 - DNA, 1034 bp, Homo sapiens
  Payload ID: 8399
  Gene Symbol: IFRD1
  Gene Name: interferon-related developmental regulator 1
  ENST ID: ENST00000421296
  CDS Start-End: 763-1034
attgtaatgtgttttaaaggctttttgatagagggtaggcttctttagctcatatgtctaagctttctatctttgaattacagttgaagtttaatgatctagtaagcacctgtaaagcatacagaaaggaaacaaggggatagttcaccctttcagaatgctttactgacatagactcataaaaatgattcaataatttaaattatagattatggagctgcaattgtttcagaaattatgtaattcttttgcatgcttttgattttatggatcaataaaagaagactgaagaggaacagaatcactttgttaaagtcatgctgtgaatttagtagcagagcttgagctgaaacgcacttcctttgatcttagttcaatattctttctctcctcacctcttttatgtataatgtttgggacctaatatattatgctgctgagaacattttcacgttgaattataaaagcaggaagatgtagaattaataagaaataaaatcattaatgtctatatatatatatttttttttttagtgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccat

SEQ ID NO: 143716 - DNA, 429 bp, Homo sapiens
  Payload ID: 8399
  Gene Symbol: IFRD1
  Gene Name: interferon-related developmental regulator 1
  ENST ID: ENST00000417662
  CDS Start-End: 377-429
agttccaaggcgggggcgcgccgaggcaggggtggggtcaccaggagaaaagcaagtgggcagaaaagcccgttgggaagagacggctgggaggaggccccggccccagccttactacgtttcccagaattcagtgaggccacgaagacaggctccctgggcgcggacggaagactggccgcatgggatttgtagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcgg

SEQ ID NO: 143717 - DNA, 437 bp, Homo sapiens
  Payload ID: 8399
  Gene Symbol: IFRD1
  Gene Name: interferon-related developmental regulator 1
  ENST ID: ENST00000462155
  CDS Start-End: 1-297
gttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggttctctggtttgtctggagtgtttgcaagtcagtcatcatagtggcagcttccgcctgctacaggatatttatatatggaagcataccatggcaggagtgctggaaaggtggtgtcagctaacagttgcttcagccagataaggacggtaacttcagtccaataaaaacctcatcagttacc

SEQ ID NO: 143718 - DNA, 486 bp, Homo sapiens
  Payload ID: 8399
  Gene Symbol: IFRD1
  Gene Name: interferon-related developmental regulator 1
  ENST ID: ENST00000476927
  CDS Start-End: 176-486
gggtccttgggcctgagagtgtgtcgggacaggggctgaccgggagctgggcgggaaaggaaccattgtcagagttcctttctcggcggcgatctcgcccgatctctccccgaccacgggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtat

SEQ ID NO: 143719 - DNA, 3397 bp, Homo sapiens
  Payload ID: 8399
  Gene Symbol: IFRD1
  Gene Name: interferon-related developmental regulator 1
  Uniprot ID: O00458
  ENST ID: ENST00000535603
  CDS Start-End: 511-1716
tttgaatgctctccatgttgatgaaattcattctttatcaagatgtaaaatatgtaatttattgtggcctctggttgctctatgtgaattgaggatactttttttttttttgttaagggaaagagggagtctggctctgtcgcccaggctggagtgcggtgtggtgtgatcatagctcactgcaacctcttaactcctgggctcaagcagctctccctcctcagcctcctgtagctaggactacaggcatgtgacaccattcctggctattttttacattttttgtggagacaaggtctatgttggccaggctggtcacgagtccctcgtccccagggatcttcctgcctaagcctcccacaatgctgggacggtgcctggtctgaggatatttcttaccactgtgtttcagcttttcctcatctgaatcaaacatttgaattctttctagaaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaagtgcttctcttctaatagaagaaatattatttatggctttgaggtacagagtccaaaatgactaggccaggtgggcagggagacaaagctttatgtgtatatttacaaacattaaagtagatgaaaagaatgtagcaatacataattgggattaaggtttctgactttcaagaatatttctgcttggcaacatgcagtgtggctcatgcctataatcagcactctggggaggctgaggcgggaggatggcatgagcccagtttgagaccagcctgggcaacatagcgagaccctgtctctaccagaaatttaaaaaatgagtgtggtggtgtgtgcttctactctttatctacttgggtgctgaggcaagagggtaacttgagcccaggaggtcaaagctgcagtgagccgtgattgtgccactccagcctgggtgacgagtgagaccttgtctcaaaagcaaaacaaaaaagaatattgctgcttgtttgcccatgaggtatatttctttcattttatgaaaagcattttgacaacacgttaacatttaataaactttagattaaaatatatagtgcaagcaacatgccatttcaaatccgtagacttgtttctttgatactcttgctgtaggtcgccgtgaggggtagggaagcatatatactgtagggagaagtatcaaaatcatttaaggtcttttttccaaactagtgttcccctcccacatcccaacaactcttggaagtctggtgctccctctaggtgaaaatcatttgctggcttatggagtcactgttgctgagtcccatcccccagttacagtgcagtggaaaacaggtttagaatctagaacttgtttgtatgttgtcacttggttatgttccaagtaggttagaaccatggaaaagagattgcaaatggtagtttcttctagatattcaaatgcatatatgtatgtacatgtaattataaataaataatgaatttttattaaagtgttgtatgaac

SEQ ID NO: 143720 - DNA, 3232 bp, Homo sapiens
  Payload ID: 8399
  Gene Symbol: IFRD1
  Gene Name: interferon-related developmental regulator 1
  Uniprot ID: O00458
  ENST ID: ENST00000621379
  CDS Start-End: 346-1551
gttaaaaccagactgcactccttctggctcctggttcattcaaggtctacatagttaaaggttgttccagagggatgtgtgtaattcctcccagtatttgatgttcctttattacttattttcacttgagccaacagcctgaactggtcaggctttgggctgatgccagctgctttatctggtagcactgttacataaaattaacatttattggtgatcactaggtgccaacattatgcgaagaactttacgtggacatcccatttaattctcagaagccgatcacaaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagttgaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtaccacttgcagtcaaatgaattccttcgaaatgtatttgaacttggacccccagtgatgcttgatgctgcaacgcttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaagtgcttctcttctaatagaagaaatattatttatggctttgaggtacagagtccaaaatgactaggccaggtgggcagggagacaaagctttatgtgtatatttacaaacattaaagtagatgaaaagaatgtagcaatacataattgggattaaggtttctgactttcaagaatatttctgcttggcaacatgcagtgtggctcatgcctataatcagcactctggggaggctgaggcgggaggatggcatgagcccagtttgagaccagcctgggcaacatagcgagaccctgtctctaccagaaatttaaaaaatgagtgtggtggtgtgtgcttctactctttatctacttgggtgctgaggcaagagggtaacttgagcccaggaggtcaaagctgcagtgagccgtgattgtgccactccagcctgggtgacgagtgagaccttgtctcaaaagcaaaacaaaaaagaatattgctgcttgtttgcccatgaggtatatttctttcattttatgaaaagcattttgacaacacgttaacatttaataaactttagattaaaatatatagtgcaagcaacatgccatttcaaatccgtagacttgtttctttgatactcttgctgtaggtcgccgtgaggggtagggaagcatatatactgtagggagaagtatcaaaatcatttaaggtcttttttccaaactagtgttcccctcccacatcccaacaactcttggaagtctggtgctccctctaggtgaaaatcatttgctggcttatggagtcactgttgctgagtcccatcccccagttacagtgcagtggaaaacaggtttagaatctagaacttgtttgtatgttgtcacttggttatgttccaagtaggttagaaccatggaaaagagattgcaaatggtagtttcttctagatattcaaatgcatatatgtatgtacatgtaattataaataaataatgaatttttattaaagtgttgtatgaac

SEQ ID NO: 143721 - DNA, 2275 bp, Homo sapiens
  Payload ID: 8400
  Gene Symbol: IFRD2
  Gene Name: interferon-related developmental regulator 2
  ENST ID: ENST00000436390
  CDS Start-End: 499-1827
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctgctagccgccgtcgcctgcgcgctcaggcctctgggattagtagttttagcctcgtggatggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttc

SEQ ID NO: 143722 - DNA, 2109 bp, Homo sapiens
  Payload ID: 8400
  Gene Symbol: IFRD2
  Gene Name: interferon-related developmental regulator 2
  Uniprot ID: Q12894
  ENST ID: ENST00000417626
  CDS Start-End: 130-1650
gtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgtggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaa

SEQ ID NO: 143723 - DNA, 664 bp, Homo sapiens
  Payload ID: 8400
  Gene Symbol: IFRD2
  Gene Name: interferon-related developmental regulator 2
  ENST ID: ENST00000426499
  CDS Start-End: 1-216
cggatctacgctgccttcaaggaagtgctgggttcgggcatgcaccaccacctccagaacaatgagctactccgtgacatctttggcctgggccctgtgctgttgctggatgccactgccctgaaggcctgcaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttc

SEQ ID NO: 143724 - DNA, 1137 bp, Homo sapiens
  Payload ID: 8400
  Gene Symbol: IFRD2
  Gene Name: interferon-related developmental regulator 2
  ENST ID: ENST00000414734
  CDS Start-End: 116-340
gtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggtgaggggtctttgggcacaggtggtagagcatctagggctgtaactctgcctctgagctcccctgcctctctgtgctcctaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagg

SEQ ID NO: 143725 - DNA, 917 bp, Homo sapiens
  Payload ID: 8400
  Gene Symbol: IFRD2
  Gene Name: interferon-related developmental regulator 2
  ENST ID: ENST00000438296
  CDS Start-End: 1-513
ctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgc

SEQ ID NO: 143726 - DNA, 1013 bp, Homo sapiens
  Payload ID: 8401
  Gene Symbol: IL1F10
  Gene Name: interleukin 1 family, member 10 (theta)
  Uniprot ID: Q8WWZ1
  ENST ID: ENST00000341010
  CDS Start-End: 76-534
agttggagtctccagggatcagggttccaggaactcaggatctgcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaa

SEQ ID NO: 143727 - DNA, 1366 bp, Homo sapiens
  Payload ID: 8401
  Gene Symbol: IL1F10
  Gene Name: interleukin 1 family, member 10 (theta)
  Uniprot ID: Q8WWZ1
  ENST ID: ENST00000393197
  CDS Start-End: 422-880
ggcagtgggactgggtttgagctgggcttatcctccaactgtgagggaggctacagcacactccaccccactctcagggctgggaattgttgtggctcagctatttgggggaatctgttttccagtttctcagaaccagcgcaagcacacacatcccaggctcacacccctggtggctggacttgctcccggatagcctcagtcagggagaggcagagctgcctggagcctgctgggctggtggaagccttggtggattctggcaggccaattatagacgaatggcctggggaacccgtgcagcccttggctgagtggttctaagccccagcacgtctgcctctggcttcacccagcctccttttctaactgcccttctctcctccccatcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaa

SEQ ID NO: 143728 - DNA, 4697 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000072516
  CDS Start-End: 171-1883
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaatttta

SEQ ID NO: 143729 - DNA, 5413 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000317757
  CDS Start-End: 207-2270
tgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaaatacagtggaagcagtttttgatttcattcagagaagcagaaggatgattgttgttctgagccctgactatgtgacagaaaagagcatcagcatgctggagtttaaactgggtgtcatgtgccagaactccattgccaccaagctcattgtggttgagtaccgtccccttgagcacccgcacccaggcattcttcagctcaaagagtctgtgtcttttgtgagctggaagggagaaaagtccaaacattctggctctaaattctggaaagctttgcggttggctcttcccctgagaagtctgagtgccagttctggctggaatgagagctgctcttcccagtctgacatcagtctggatcacgttcaaaggaggagaagtcgtttgaaagagcccccagaacttcagagctcagagagggctgcaggtagccctccagccccaggcacaatgtccaagcaccgagggaagtcctccgccacctgccgctgttgtgtcacctactgtgaaggagagaatcaccttaggaacaagagccgggcagagattcataaccagccccagtgggagacacacctctgtaagcctgttccccaagagtcagaaactcaatggatacaaaatggcaccagattggaaccccctgctccccagatctcagcccttgctcttcatcatttcacggacttatccaataacaacgacttttatatcctataattactgtgtgtggtgggtggtggctactatctctaccaaccctctgtatgtcatgaacctgtgggaaaatctgacatttttatcatctaatggactatcagatttctgtcccctttattgatttttaaaaactatttatttctaggagacaaaagacctgaaggacctgaatccagaattattgcctctaaaggcctcagaagagcacactcttcttgggccctagaaggtcagtatgtgaaagttgcctaaagtctgatcctctatcttgtccaatggtttaaaactgagctaagaatttaaatgtgtttcttttcagtgagttgatcaacctcacattataagtcagtcaggtgtacttgggctatgatgcttacagggtgtatgcattcccagggagcagcatggaaaggagctggttctggtggaagctgtaggacgaagctcaacagaaaacctacagcacatttttcctcaaagaaccaaacatacccacccagggatacatggcgttctctgtctcactgtaaactagtgttctctaaactgcctaacattgttagcatcaataaaattctatttttacgtcattttatttgtactaacaaatttttacatctctctcacccttctacttcctatgattgttgtattcttatctggagagtattccatttcagaaaatggagatttggtttaggtaccagaaaaactaagatgccttttttgtttctctctgatatgtaatgggagagatgtggaaaataaccaaaagagagggagaatgtgacttaaatgaaatggaagtttacaacaatctcatatttttagaactgacagatgaaaaattccgtattgtaagtgatgtagcgtagaaataggtgccttcgtcccattcaggcttctgagaagggataataaattcaagtgcctacaaggatcagaaggtaagagaaaagagaaaatatggccagataccagcttattttacatgctctccatctagaactgatgtgaatagggacataggcacagatagttatttcttctctgtaaacattttcataaactcatataaggcacatggcatttgatttccaagtcaggtagatcattggccctctaagcaactgaagaacacatatttcttaaaaagggtcagcttcaggccgggtgtggtggctcatgcctataatcccagcactttgggaagtcaagacttgtggatcaactgaggtcagttgttcaagagcagcctggccaacattgtgaaaccccatctctacaaaaatacaaaattagccaggtatggtggtgggcacctgtaatcccagctactcaggaggctgaggcaggagaaactcttgaacctaggaggtggaggttgcagtgagccgagatcgtgccactgcactccagacttggtgacagagcaagactccatcttaaaaaaaaaaaaaaaaatgggtagcttctactcagttccatttgatttttgtcactaattgagccccaatgttgccatattgtccatttttttctaaagaatctaaaaaattcagatttttatgtataatgtcaattatgggatggcttaaagttaagaaggaaaaaacaaagagccaaacaaattatatctgtgggacatagttagcctgagggcaactagtttgtaatttcataactaaagtattcagccaaagaacatatctccaaatggaattttagtgtccctgataataccagaactggaagacacaggttggctctaaggacatagtggagcatgtttatcctctcctcaaattgaagacatctgggctgttacaattgagctgatctgacctaaccctccattagaaaagaaaaatctggaaaattcggtgccttccatttactctttagaggtttcttgcctgcttactgtcagaaaataagaagaacgaagtctgctactcctgaacatgagcagaaccaaaaaagcaagagaccacaccttacatgagaagtcacctttaatacattagctgtggctgttagtgagttgtggcccaatgagtgtcagtggctcccggtcagtaacagtgaatgggcagtggggaaagaaagaaagcagtttcatctcactacccctcttgaaaatgttctcagaagatcctttctttgtcgaaacaaacaaacaaacaaaaaactagaagattcctactccaaagatgggggaacaagggccccctagagtaaatgtgaactcaccctgaaacttgtaatcagaaaacgacaggccaccctaactaaatatccagtagaaaatgacttagcacaacccaaaggccttgtcctctattaaatcccttcttgtaaagaataatccatccttgatgtatattcaagaaccttcagttggaagacagatagcagtttctctccaaatctattaataatgggtaatgtaagcggctccgaagctcaaggagggagaagattctctgacccactatcagtgttatgccttattaacacagcatctcaaagtgtaaaatatctttggaagaaaatgagaaattaaatttttcatttatacattattttctgttttagtgaagacaaagaaatgaaagaactattggcagagtcatggaaaattaaatatgagctcatattatatgagtagctagaaaattttggtgctctcaaaactacattttggcaagtatcaatttccttggacaatataagtgtagtggaagcagtaaaagtcttagttttcagtattagttatacagcggtcagaaagataatagactatacttctactgtatggagaaaggatcagaggttatattattatttcttgacctgacatgccaaattgaatgtgatgttcagtaccatacatttcaatgaagcaaattataataagaaagaaatttttttcatgggccatgcatatccataatagaaataacaggattgtagggtaaatggatatatcattgcataagaaatattgtctacttagttgcatgagttttaaatcaaatagagatggatgtgagtcctacttctctcctatctgtttgaacatggtctctctgagcctcaatttcctactagctaaaataaagatactattatcaacctca

SEQ ID NO: 143730 - DNA, 4490 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000342550
  CDS Start-End: 120-1160
tgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttg

SEQ ID NO: 143731 - DNA, 1957 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000422940
  CDS Start-End: 120-1190
tgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaa

SEQ ID NO: 143732 - DNA, 534 bp, Homo sapiens
  Payload ID: 8402
  Gene Symbol: IL1RAP
  Gene Name: interleukin 1 receptor accessory protein
  ENST ID: ENST00000422625
  CDS Start-End: 196-534
ctcactggggaagactgccgggatccaggtctccggggtccgctttggccagaggcgcggaaggaagcagtgcccggcgacactgcacccatcccggctgcttttgctgcgccctctcagcttcccaagaaagtccttttgcagattgctcagcacaggacatgataattttcatctcggattttggaggaattgatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacc

SEQ ID NO: 143733 - DNA, 4769 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000447382
  CDS Start-End: 250-1962
aaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttg

SEQ ID NO: 143734 - DNA, 1565 bp, Homo sapiens
  Payload ID: 8402
  Gene Symbol: IL1RAP
  Gene Name: interleukin 1 receptor accessory protein
  ENST ID: ENST00000434491
  CDS Start-End: 192-839
tgccgggatccaggtctccggggtccgctttggccagaggcgcggaaggaagcagtgcccggcgacactgcacccatcccggctgcttttgctgcgccctctcagcttcccaagaaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaat

SEQ ID NO: 143735 - DNA, 2244 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000439062
  CDS Start-End: 414-2126
aaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaagggctttgacctgaagcttgaaattgagtttgggacaataatgtgtctcatggggaattgcatggactccttatcataagccaaatgctgaggtaaagctgcggaattgagtcgtcctccaagaagggagagaaaatgatgtcttgtgacatttccagataactggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaata

SEQ ID NO: 143736 - DNA, 2760 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000443369
  CDS Start-End: 108-2171
agaacagtccctagtctatagtcagcaggcatgaatgctagttattattatttaagcccttgaaagtagtaagtgatttcccttacctttgtatttatggttacaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaaatacagtggaagcagtttttgatttcattcagagaagcagaaggatgattgttgttctgagccctgactatgtgacagaaaagagcatcagcatgctggagtttaaactgggtgtcatgtgccagaactccattgccaccaagctcattgtggttgagtaccgtccccttgagcacccgcacccaggcattcttcagctcaaagagtctgtgtcttttgtgagctggaagggagaaaagtccaaacattctggctctaaattctggaaagctttgcggttggctcttcccctgagaagtctgagtgccagttctggctggaatgagagctgctcttcccagtctgacatcagtctggatcacgttcaaaggaggagaagtcgtttgaaagagcccccagaacttcagagctcagagagggctgcaggtagccctccagccccaggcacaatgtccaagcaccgagggaagtcctccgccacctgccgctgttgtgtcacctactgtgaaggagagaatcaccttaggaacaagagccgggcagagattcataaccagccccagtgggagacacacctctgtaagcctgttccccaagagtcagaaactcaatggatacaaaatggcaccagattggaaccccctgctccccagatctcagcccttgctcttcatcatttcacggacttatccaataacaacgacttttatatcctataattactgtgtgtggtgggtggtggctactatctctaccaaccctctgtatgtcatgaacctgtgggaaaatctgacatttttatcatctaatggactatcagatttctgtcccctttattgatttttaaaaactatttatttctaggagacaaaagacctgaaggacctgaatccagaattattgcctctaaaggcctcagaagagcacactcttcttgggccctagaaggtcagtatgtgaaagttgcctaaagtctgatcctctatcttgtccaatggtttaaaactgagctaagaatttaaatgtgtttcttttcagtgagttgatcaacctcacattataagtcagtcaggtgtacttgggctatgatgcttacagggtgtatgcattcccagggagcagcatggaaaggagctggttctggtggaagctgtaggacgaagctcaacagaaaacctacagcacatttttcctcaaagaaccaaacatacccacccagggatacatggcgttctctgtctcactgtaaactagtgttctctaaactgcctaacattgttagcatcaataaaattctatttttacgtc

SEQ ID NO: 143737 - DNA, 2048 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000422485
  CDS Start-End: 211-1281
agactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaa

SEQ ID NO: 143738 - DNA, 523 bp, Homo sapiens
  Payload ID: 8402
  Gene Symbol: IL1RAP
  Gene Name: interleukin 1 receptor accessory protein
  ENST ID: ENST00000453359
  CDS Start-End: 89-523
agatatttcttgggtagtagaaaaagaaatacttcacagagctgtcaaatctccacatcttcagcattaaatatcatgcaaccaaatgatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactccca

SEQ ID NO: 143739 - DNA, 4875 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000412504
  CDS Start-End: 350-2062
gccagaaagctggagtttgatcatagctctaccactctctagccaaaggatcgtggtgatgttattgaaacttgtctctagccaaaggatcttagttatgttatttaaacctgtgtattaaacttctttatctgcatgtaatatgggaattgaaaaacaaacaacaaaaaaacagaaacaaaataaaacctgtcttattggttggttctgacaatgaaatttgttaatattgtaaaattcttagaacagtccctagtctatagtcagcaggcatgaatgctagttattattatttaagcccttgaaagtagtaagtgatttcccttacctttgtatttatggttacaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaatttt

SEQ ID NO: 143740 - DNA, 795 bp, Homo sapiens
  Payload ID: 8402
  Gene Symbol: IL1RAP
  Gene Name: interleukin 1 receptor accessory protein
  ENST ID: ENST00000412080
  CDS Start-End: 1-581
tgtttattcacataggaacctccaaacatatagaagtaaagacacagggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaat

SEQ ID NO: 143741 - DNA, 4577 bp, Homo sapiens
  Payload ID: 8402
  Gene Symbol: IL1RAP
  Gene Name: interleukin 1 receptor accessory protein
  Uniprot ID: Q9NPH3
  ENST ID: ENST00000413869
  CDS Start-End: 207-1247
tgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttg

SEQ ID NO: 143742 - DNA, 1314 bp, Homo sapiens
  Payload ID: 8403
  Gene Symbol: IL1RAPL1
  Gene Name: interleukin 1 receptor accessory protein-like 1
  ENST ID: ENST00000302196
  CDS Start-End: 1-1314
ggtgactctgctaatctaacctgcagagctttctttgggtacagcggagatgtcagtcctttaatttactggatgaaaggagaaaaatttattgaagatctggatgaaaatcgagtttgggaaagtgacattagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgagagctaatgtacacagtggaacttgctggaggccttggtgctatactcttgctgcttgtatgtttggtgaccatctacaagtgttacaagatagaaatcatgctcttctacaggaatcattttggagctgaagagctcgatggagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaacatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtga

SEQ ID NO: 143743 - DNA, 3667 bp, Homo sapiens
  Payload ID: 8403
  Gene Symbol: IL1RAPL1
  Gene Name: interleukin 1 receptor accessory protein-like 1
  Uniprot ID: Q9NZN1
  ENST ID: ENST00000378993
  CDS Start-End: 674-2764
gagacaccttcccaaacagcaggggttgtgtgctttcacatagcagtactgtacaaggaaaaccccgtcggatctgttattgcgggatacttgtgaaatatacataggattctttcttatggctgcatcccggatctggaaattttacttggggaccaggaggatttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgtttttttttttcctgctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtggggaacggcctttaagagctggaagatgaaagctccgattccacacttgattctcttatacgctacttttactcagagtttgaaggttgtgaccaaaagaggctccgccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacagcccctctgactgataagccacccaagcttttgtatcctatggaaagtaaactgacaattcaggagacccagctgggtgactctgctaatctaacctgcagagctttctttgggtacagcggagatgtcagtcctttaatttactggatgaaaggagaaaaatttattgaagatctggatgaaaatcgagtttgggaaagtgacattagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgagagctaatgtacacagtggaacttgctggaggccttggtgctatactcttgctgcttgtatgtttggtgaccatctacaagtgttacaagatagaaatcatgctcttctacaggaatcattttggagctgaagagctcgatggagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaacatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgctgctgttaaaaaacatgcattagaatctctagaacacgaggaaaaacagggtcttgtacatatgttttttggaatttctttgtagcatcagtgtcctcctgttttaccatgtcttttaccattacattttttgactttgttttatatgtcgttggaatttgtaaatttacattttttttaaagaagagactgatgtgtagatagaaaaccctttttttgcttcattagtttagttttagaatgggtttttattttatttccttttttaaaattttactttgcttttaacatttccttggggtgcttggacaaatctatccgatgggacaaggagcaccggattctttctcgggttctgcctagcatcaactgggccacgtcggccttcagagaacagtgcaacaaatgccagcattgccattcgggggaaaaaaaaaaaaaaaaaaaaaagatgagaagaacacttgttcataggagggccccaccagtcagagccctgaatctcttccttgtcccacctcattccccacctctacctttctaatggcggcatgatgtgtaaactctgtgcaggggtgggggcgggtctaactgtcttaacattcaagtcactgctcttcagaatacactctagacccaaaggtgtgctaatcacttcacagtgaccactacagagtactaagaagagaagatcaagggcatgaaattggggaagagtgttatttccgttttttaaatgagttgatgtacccttatatatatatacatatatatataaatataaatatatataaaaacaacaaaacaaaacaaaaaaagaaaa

SEQ ID NO: 143744 - DNA, 1290 bp, Homo sapiens
  Payload ID: 8404
  Gene Symbol: IL1RAPL2
  Gene Name: interleukin 1 receptor accessory protein-like 2
  ENST ID: ENST00000344799
  CDS Start-End: 1-1290
ggtaagcctctgaacatcccctgcaaagcattcttcggattcagtggagagtctgggccaatgatctactggatgaaaggagaaaagtttattgaagaactggcaggtcacattagagaaggtgaaataaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaaggatttaatctataaaattgagcttgcagggggcctgggagcaatcttcctcctccttgtactgctggtggtcatttacaaatgctacaacattgaattgatgctcttctacaggcagcactttggagctgatgaaactaatgatgacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaacatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtag

SEQ ID NO: 143745 - DNA, 2985 bp, Homo sapiens
  Payload ID: 8404
  Gene Symbol: IL1RAPL2
  Gene Name: interleukin 1 receptor accessory protein-like 2
  Uniprot ID: Q9NP60
  ENST ID: ENST00000372582
  CDS Start-End: 757-2817
gtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcagctgtcaagaaaagtgaaggatgaagccaccatttcttttggcccttgtggtctgttctgtagtcagcacaaatctgaagatggtgtcaaagagaaattctgtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacagctttactcacagacaagcctcccaagccattgttccccatggagaatcagccaagtgttatagatgtccagctgggtaagcctctgaacatcccctgcaaagcattcttcggattcagtggagagtctgggccaatgatctactggatgaaaggagaaaagtttattgaagaactggcaggtcacattagagaaggtgaaataaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaaggatttaatctataaaattgagcttgcagggggcctgggagcaatcttcctcctccttgtactgctggtggtcatttacaaatgctacaacattgaattgatgctcttctacaggcagcactttggagctgatgaaactaatgatgacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaacatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtagtgaaaaatctgaattcctctgaacagctagataagcatagagaatttctgttataccaagcataaagtacacctaataacgttgtgttaaaaaagtgtttgaagaaaaaggtacaaaaatggcttttatacttaaatatttttgtttacatttccagaatagtggggg

SEQ ID NO: 143746 - DNA, 1810 bp, Homo sapiens
  Payload ID: 8405
  Gene Symbol: IL1RN
  Gene Name: interleukin 1 receptor antagonist
  Uniprot ID: P18510
  ENST ID: ENST00000259206
  CDS Start-End: 123-665
agctccaccctgggagggactgtggcccaggtactgcccgggtgctactttatgggcagcagctcagttgagttagagtctggaagacctcagaagacctcctgtcctatgaggccctccccatggctttagctgacttgtatgaagaaggaggtggaggaggaggagaaggtgaagacaatgctgactcaaaggagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccta

SEQ ID NO: 143747 - DNA, 1747 bp, Homo sapiens
  Payload ID: 8405
  Gene Symbol: IL1RN
  Gene Name: interleukin 1 receptor antagonist
  Uniprot ID: P18510
  ENST ID: ENST00000354115
  CDS Start-End: 123-602
agctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccta

SEQ ID NO: 143748 - DNA, 1922 bp, Homo sapiens
  Payload ID: 8405
  Gene Symbol: IL1RN
  Gene Name: interleukin 1 receptor antagonist
  Uniprot ID: P18510
  ENST ID: ENST00000361779
  CDS Start-End: 346-777
gggcagctccaccctgggagggactgtggcccaggtactgcccgggtgctactttatgggcagcagctcagttgagttagagtctggaagacctcagaagacctcctgtcctatgaggccctccccatggctttagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccta

SEQ ID NO: 143749 - DNA, 848 bp, Homo sapiens
  Payload ID: 8405
  Gene Symbol: IL1RN
  Gene Name: interleukin 1 receptor antagonist
  Uniprot ID: P18510
  ENST ID: ENST00000409930
  CDS Start-End: 65-598
atttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagccctt

SEQ ID NO: 143750 - DNA, 1903 bp, Homo sapiens
  Payload ID: 8405
  Gene Symbol: IL1RN
  Gene Name: interleukin 1 receptor antagonist
  Uniprot ID: P18510
  ENST ID: ENST00000409052
  CDS Start-End: 472-903
gaattagcagttcacaaagcacattcgcatataagggcttgttttgaattgatcttggcagcaattctatgagacaagtaaaagcacaagaggaataggaactgcacctcttccttcagtttcagcttgaataatatcaggaagattcgtatcggtctgagttgggtcacgtacccgacgtgctatagctgaggatgggctgacttgtatgaagaaggaggtggaggaggaggagaaggtgaagacaatgctgactcaaaggggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgc

SEQ ID NO: 143751 - DNA, 5143 bp, Homo sapiens
  Payload ID: 8406
  Gene Symbol: IL1R1
  Gene Name: interleukin 1 receptor, type I
  Uniprot ID: P14778
  ENST ID: ENST00000410023
  CDS Start-End: 319-2028
gccggagccgactcggagcgcgcggcgccggccgggaggagccggagagcggccgggccgggcggtgggggcgccggcctgccccgcgcgccccagggagcggcaggaatgtgacaatcgcgcgcccgcgcaccgaagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 143752 - DNA, 1735 bp, Homo sapiens
  Payload ID: 8406
  Gene Symbol: IL1R1
  Gene Name: interleukin 1 receptor, type I
  ENST ID: ENST00000409288
  CDS Start-End: 319-1662
gccggagccgactcggagcgcgcggcgccggccgggaggagccggagagcggccgggccgggcggtgggggcgccggcctgccccgcgcgccccagggagcggcaggaatgtgacaatcgcgcgcccgcgcaccgaagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaa

SEQ ID NO: 143753 - DNA, 3544 bp, Homo sapiens
  Payload ID: 8406
  Gene Symbol: IL1R1
  Gene Name: interleukin 1 receptor, type I
  ENST ID: ENST00000409589
  CDS Start-End: 394-915
acggccgagggattaaagccctaagaggctgtgacacagccatctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatgccccaaggatgaagaacggagacggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttg

SEQ ID NO: 143754 - DNA, 1858 bp, Homo sapiens
  Payload ID: 8406
  Gene Symbol: IL1R1
  Gene Name: interleukin 1 receptor, type I
  ENST ID: ENST00000409929
  CDS Start-End: 242-1858
attggcagctcttcacttgtatcttttcatatcaaaaatgggaggtgacacccagtttaaggaaaattccaaggcatttgtctcgactaatgtgaaagatgattacagtggccagaggactgccaaggctccttctcaagctgcttgagtcaatgagggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtag

SEQ ID NO: 143755 - DNA, 1862 bp, Homo sapiens
  Payload ID: 8406
  Gene Symbol: IL1R1
  Gene Name: interleukin 1 receptor, type I
  ENST ID: ENST00000409329
  CDS Start-End: 388-1731
gagggattaaagccctaagaggctgtgacacagccatctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatgccccaaggatgaagaacggagacggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctc

SEQ ID NO: 143756 - DNA, 574 bp, Homo sapiens
  Payload ID: 8406
  Gene Symbol: IL1R1
  Gene Name: interleukin 1 receptor, type I
  ENST ID: ENST00000422532
  CDS Start-End: 1-374
ataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtc

SEQ ID NO: 143757 - DNA, 577 bp, Homo sapiens
  Payload ID: 8406
  Gene Symbol: IL1R1
  Gene Name: interleukin 1 receptor, type I
  ENST ID: ENST00000442590
  CDS Start-End: 234-577
agtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtgga

SEQ ID NO: 143758 - DNA, 609 bp, Homo sapiens
  Payload ID: 8406
  Gene Symbol: IL1R1
  Gene Name: interleukin 1 receptor, type I
  ENST ID: ENST00000452403
  CDS Start-End: 369-609
gaaacatttaccagatgtgtggcttgagtgtccattcccgcaacaaaaacgctctgcagtaaagctccgagatggctgtgtttgtgttggactgctctagatgcacaaccctcctggacaaagcgtttttcctcagccttcaccacccatggaggaggtgtgattacctctattcacagaaaggagactgggacccaaccaaggcaagtcatttgcttcagaccacagagcaaagaatcattctgtcattccagaaatatttgtcaggcgcccctggtgtgtcaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaac

SEQ ID NO: 143759 - DNA, 1678 bp, Homo sapiens
  Payload ID: 8406
  Gene Symbol: IL1R1
  Gene Name: interleukin 1 receptor, type I
  ENST ID: ENST00000413623
  CDS Start-End: 76-435
accctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcag

SEQ ID NO: 143760 - DNA, 709 bp, Homo sapiens
  Payload ID: 8406
  Gene Symbol: IL1R1
  Gene Name: interleukin 1 receptor, type I
  ENST ID: ENST00000430171
  CDS Start-End: 163-709
gtgactccctcctgagaagctggaccccttggtaaaagacaaggccttctccaagacttaaaacacacttcacgcagtcacagaaagagctcatagaccagactgcggggcttcaaagccttctatcttatttaatcatctgtaaatagtttaaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcg

SEQ ID NO: 143761 - DNA, 1525 bp, Homo sapiens
  Payload ID: 8406
  Gene Symbol: IL1R1
  Gene Name: interleukin 1 receptor, type I
  ENST ID: ENST00000428279
  CDS Start-End: 630-1525
agtcacttgctgaagactagcgaagtggagggggaaagcccgagggagctgcagactcgaccactgcgccctcccctcctctccctgcaaggagcccaaggtgtgatcctgccaggcgttcgttcgctgcatgaccttggccatccttccattcccctgggtgtgaattctcattggcaaagtagacgcaccctctgaagatggtgactccctcctgagaagctggaccccttggtaaaagacaaggccttctccaagataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaa

SEQ ID NO: 143762 - DNA, 549 bp, Homo sapiens
  Payload ID: 8406
  Gene Symbol: IL1R1
  Gene Name: interleukin 1 receptor, type I
  ENST ID: ENST00000450319
  CDS Start-End: 232-549
cttcttggaggatggcccatgaagacctccaaacaagctggaggggccagtcacttgctgaagactagcgaagtggagggggaaagcccgagggagctgcagactcgaccactgcgccctcccctcctctccctgcaaggagcccaaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcaga

SEQ ID NO: 143763 - DNA, 2658 bp, Homo sapiens
  Payload ID: 8406
  Gene Symbol: IL1R1
  Gene Name: interleukin 1 receptor, type I
  ENST ID: ENST00000424272
  CDS Start-End: 242-1585
attggcagctcttcacttgtatcttttcatatcaaaaatgggaggtgacacccagtttaaggaaaattccaaggcatttgtctcgactaatgtgaaagatgattacagtggccagaggactgccaaggctccttctcaagctgcttgagtcaatgagggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttaatgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttgtgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtag

SEQ ID NO: 143764 - DNA, 1578 bp, Homo sapiens
  Payload ID: 8407
  Gene Symbol: IL1R2
  Gene Name: interleukin 1 receptor, type II
  Uniprot ID: P27930
  ENST ID: ENST00000332549
  CDS Start-End: 230-1426
cccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaactccgtacgtcttctcttatggaagtggctgtgtctttttgagggactctgttctttgcctcagttgtctaccaaaggtgccacatttatagtggctttgtagtaaaggactaaagtctta

SEQ ID NO: 143765 - DNA, 1405 bp, Homo sapiens
  Payload ID: 8407
  Gene Symbol: IL1R2
  Gene Name: interleukin 1 receptor, type II
  Uniprot ID: P27930
  ENST ID: ENST00000393414
  CDS Start-End: 184-1380
gtgggatgggagatactgttgtggtcacctctggaaaatacattctgctactcttaaaaactagtgacgctcatacaaatcaacagaaagagcttctgaaggaagactttaaagctgcttctgccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaa

SEQ ID NO: 143766 - DNA, 792 bp, Homo sapiens
  Payload ID: 8407
  Gene Symbol: IL1R2
  Gene Name: interleukin 1 receptor, type II
  ENST ID: ENST00000457817
  CDS Start-End: 105-792
gactcagagatgagacagttgcctaaaaacttctgggaacaaggccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaaga

SEQ ID NO: 143767 - DNA, 1106 bp, Homo sapiens
  Payload ID: 8407
  Gene Symbol: IL1R2
  Gene Name: interleukin 1 receptor, type II
  Uniprot ID: P27930
  ENST ID: ENST00000441002
  CDS Start-End: 62-952
gccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccagtaagtgggccagggtcttctgttgagaactctgtgggtttcgctcttccttttggagacagttatcactatgacccacataccacattaaaagttactttttttgattccaaactgttggatgtttagaatttaaaaaattgtattttgctaaaaat

SEQ ID NO: 143768 - DNA, 2058 bp, Homo sapiens
  Payload ID: 8408
  Gene Symbol: IL1RL1
  Gene Name: interleukin 1 receptor-like 1
  Uniprot ID: Q01638
  ENST ID: ENST00000233954
  CDS Start-End: 272-1942
aaagagaggctggctgttgtatttagtaaagctataaagctgtaagagaaattggctttctgagttgtgaaactgtgggcagaaagttgaggaagaaagaactcaagtacaacccaatgaggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaattgatcatcatagcatctactgcataattgcagtatgtagtgtatttttaatgctaatcaatgtcctggttatcatcctaaaaatgttctggattgaggccactctgctctggagagacatagctaaaccttacaagactaggaatgatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctc

SEQ ID NO: 143769 - DNA, 3994 bp, Homo sapiens
  Payload ID: 8408
  Gene Symbol: IL1RL1
  Gene Name: interleukin 1 receptor-like 1
  Uniprot ID: Q01638
  ENST ID: ENST00000311734
  CDS Start-End: 340-1326
gtacatgatgcaccagcatttttgaacaagtcatagatttggccacaaatcaaatttcaggatgggaggagtgtctcccctttaaaatagaagagagtgagtagtctatgaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccactcacactgcccttgtgtactcctgctttgctacgttatcattgatcaatgtccctggttacctatgtgtttgaattatcttcgtgttacaggtgtttaatgattttgctccttctagcttatttgtatttcacctgtttttctttaaatcaacatggttacactctgtttcagcaactgtataaattaaacacaaattattactactgcta

SEQ ID NO: 143770 - DNA, 3571 bp, Homo sapiens
  Payload ID: 8408
  Gene Symbol: IL1RL1
  Gene Name: interleukin 1 receptor-like 1
  Uniprot ID: Q01638
  ENST ID: ENST00000404917
  CDS Start-End: 269-904
aaagagaggctggctgttgtatttagtaaagctataaagctgtaagagaaattggctttctgagttgtgaaactgtgggcagaaagttgaggaagaaagaactcaagtacaacccaatgagggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccactcacactgcccttgtgtactcctgctttgctacgttatcattgatcaatgtccctggttacctatgtgtttgaattatcttcgtgttacaggtgtttaatgattttgctccttctagcttatttgtatttcacctgtttttctttaaatcaacatggttacactctgtttcagcaactgtataaattaaacacaaattattactactgct

SEQ ID NO: 143771 - DNA, 2693 bp, Homo sapiens
  Payload ID: 8408
  Gene Symbol: IL1RL1
  Gene Name: interleukin 1 receptor-like 1
  ENST ID: ENST00000409584
  CDS Start-End: 230-1174
aggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactga

SEQ ID NO: 143772 - DNA, 1680 bp, Homo sapiens
  Payload ID: 8408
  Gene Symbol: IL1RL1
  Gene Name: interleukin 1 receptor-like 1
  Uniprot ID: Q01638
  ENST ID: ENST00000427077
  CDS Start-End: 200-979
cttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggtttggtgtcagagtttctgcaaattaaaaaagagcttaatctttagtaatactcattggattcaaagtctaatgagaggctttgtgatggtatactatggtgtacataaatgttgtcgagtggtttttaatctttgtttgcaatactttcaacatcatcaatggccttgaatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactg

SEQ ID NO: 143773 - DNA, 545 bp, Homo sapiens
  Payload ID: 8408
  Gene Symbol: IL1RL1
  Gene Name: interleukin 1 receptor-like 1
  ENST ID: ENST00000447231
  CDS Start-End: 430-545
gtgaaactgtgggcagaaagttgaggaagaaagaactcaagtacaacccaatgagggcataaggaaatcggaggcatgtttctgtctggctataacagttctcctactagatcctgaggccaaactattcacatgccattgttcctgaataccattgtggacataatcatctaattttggctattccatgcagagatatgctgctgtgactgctgacttgaatgttacgggatccccagcaggatctgggattctctctgttcttgaatgcgttgtttagttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagaca

SEQ ID NO: 143774 - DNA, 2615 bp, Homo sapiens
  Payload ID: 8409
  Gene Symbol: IL1RL2
  Gene Name: interleukin 1 receptor-like 2
  Uniprot ID: Q9HB29
  ENST ID: ENST00000264257
  CDS Start-End: 127-1854
cccgcccacggtggcggggaaatacctaggcatggaagtggcatgacagggctcgtgtccctgtcatattttccactctccacgaggtcctgcgcgcttcaatcctgcaggcagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattacagaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctagacacccagttgagctcaggcgtagagaagaggaggatgggataagaactggggccatccccatgtcatggtgggtgagagctggggccatccccgtggtcatggagggtgagagctgggggttatccccatggtcatggagggtgagggctggtcgggggaggcatccccaagtcatggtgggtgagagctcggagcatccccatgtcatggtgggtgagatctgggggtatccctgtgtcatggtgggtgagggcgggtggtcatccacatggtcatagtgggtgagagctgggggtatccctacatcatggtgggtgagagctgggagcatccccatgtcatggtgggcgagatctggggggtatccccacgtcatggtggatgagagctgggggaatcaccatgtcatggtgggtgagatcttgggggatcacctgtcatggtgggtgagagctggggggatcacctgtcatggtgggtgagagttgggattcatccccatgtcatggtgggctgagcccacatggaagcctgtgcttggacagcgtatgcccttttctctgtttttccacaatgaacaattaaactgtaaatgttaaaaatatcagtaatttgtgaaataaattttattctcatttgagcaacataaa

SEQ ID NO: 143775 - DNA, 557 bp, Homo sapiens
  Payload ID: 8409
  Gene Symbol: IL1RL2
  Gene Name: interleukin 1 receptor-like 2
  ENST ID: ENST00000421464
  CDS Start-End: 42-557
ctttctcctttcccgctggcccttgccagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcgg

SEQ ID NO: 143776 - DNA, 1484 bp, Homo sapiens
  Payload ID: 8409
  Gene Symbol: IL1RL2
  Gene Name: interleukin 1 receptor-like 2
  Uniprot ID: Q9HB29
  ENST ID: ENST00000441515
  CDS Start-End: 1-1374
atgacagggctcgtgtccctgtcatattttccactctccacgaggtcctgcgcgcttcaatcctgcagcccggtttggggatgtggtccttgctgctctgcgggttgtccatcgcccttccactgtctgtcacagcaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattaaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctaga

SEQ ID NO: 143777 - DNA, 2124 bp, Homo sapiens
  Payload ID: 8410
  Gene Symbol: IL1A
  Gene Name: interleukin 1, alpha
  Uniprot ID: P01583
  ENST ID: ENST00000263339
  CDS Start-End: 157-972
ttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttcttgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgaca

SEQ ID NO: 143778 - DNA, 1631 bp, Homo sapiens
  Payload ID: 8411
  Gene Symbol: IL1B
  Gene Name: interleukin 1, beta
  Uniprot ID: P01584
  ENST ID: ENST00000263341
  CDS Start-End: 212-1021
accaatactcttttcccctttcctttaacttgattgtgaaatcaggtattcaacagagaaatttctcagcctcctacttctgcttttgaaagccataaaaacagcgagggagaaactggcagataccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaa

SEQ ID NO: 143779 - DNA, 580 bp, Homo sapiens
  Payload ID: 8411
  Gene Symbol: IL1B
  Gene Name: interleukin 1, beta
  ENST ID: ENST00000416750
  CDS Start-End: 248-580
actttaatcttccttacaactaggtgctaagggagtctctctgtctctctgcctctttgtgtgtatgcatattctctctctctctctctttctttctctgtctctccctctccttccctctctgcctccctctctcagctttttgcaaaaatgccaggtgtaatataatgcttatgactcgggaaatattctgggaatggatactgcttatctaacagctgacaccctaaaggtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgag

SEQ ID NO: 143780 - DNA, 581 bp, Homo sapiens
  Payload ID: 8411
  Gene Symbol: IL1B
  Gene Name: interleukin 1, beta
  ENST ID: ENST00000418817
  CDS Start-End: 153-581
gaaagccataaaaacagcgagggagaaactggcagataccaaacctcttcgaggcacaaggcacaacaggctgctctgggattctcttcagccaatcttcattgctcaagtatgactttaatcttccttacaactaggtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaa

SEQ ID NO: 143781 - DNA, 581 bp, Homo sapiens
  Payload ID: 8411
  Gene Symbol: IL1B
  Gene Name: interleukin 1, beta
  ENST ID: ENST00000432018
  CDS Start-End: 206-581
aatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgc

SEQ ID NO: 143782 - DNA, 1630 bp, Homo sapiens
  Payload ID: 8412
  Gene Symbol: IL10
  Gene Name: interleukin 10
  Uniprot ID: P22301
  ENST ID: ENST00000423557
  CDS Start-End: 60-596
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatca

SEQ ID NO: 143783 - DNA, 3695 bp, Homo sapiens
  Payload ID: 8413
  Gene Symbol: IL10RA
  Gene Name: interleukin 10 receptor, alpha
  Uniprot ID: Q13651
  ENST ID: ENST00000227752
  CDS Start-End: 121-1857
gacgtcagccctgcggggcgctggcggagcgggcggcggagctgtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 143784 - DNA, 1779 bp, Homo sapiens
  Payload ID: 8413
  Gene Symbol: IL10RA
  Gene Name: interleukin 10 receptor, alpha
  ENST ID: ENST00000526544
  CDS Start-End: 75-359
agtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgca

SEQ ID NO: 143785 - DNA, 2275 bp, Homo sapiens
  Payload ID: 8413
  Gene Symbol: IL10RA
  Gene Name: interleukin 10 receptor, alpha
  ENST ID: ENST00000534574
  CDS Start-End: 75-341
agtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcag

SEQ ID NO: 143786 - DNA, 1963 bp, Homo sapiens
  Payload ID: 8414
  Gene Symbol: IL10RB
  Gene Name: interleukin 10 receptor, beta
  Uniprot ID: Q08334
  ENST ID: ENST00000290200
  CDS Start-End: 109-1086
gccccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgata

SEQ ID NO: 143787 - DNA, 898 bp, Homo sapiens
  Payload ID: 8414
  Gene Symbol: IL10RB
  Gene Name: interleukin 10 receptor, beta
  ENST ID: ENST00000451065
  CDS Start-End: 1-651
gataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagagaaactggtcagacaggaaagaacagacggaatgaacggtagaggggcctgctggcataagctctcacctccgaggctagaagactttgcagacttgaccgtggagccagccccttttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggcccca

SEQ ID NO: 143788 - DNA, 786 bp, Homo sapiens
  Payload ID: 8414
  Gene Symbol: IL10RB
  Gene Name: interleukin 10 receptor, beta
  ENST ID: ENST00000422891
  CDS Start-End: 85-300
cggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcgga

SEQ ID NO: 143789 - DNA, 2281 bp, Homo sapiens
  Payload ID: 8415
  Gene Symbol: IL11
  Gene Name: interleukin 11
  Uniprot ID: P20809
  ENST ID: ENST00000264563
  CDS Start-End: 64-663
gaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccttttgtttgttttttgagatggagtctcgctctgttgcctaggctggagtgcagtgaggcaatctgaggtcactgcaacctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaacaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagttcgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaat

SEQ ID NO: 143790 - DNA, 1028 bp, Homo sapiens
  Payload ID: 8415
  Gene Symbol: IL11
  Gene Name: interleukin 11
  Uniprot ID: P20809
  ENST ID: ENST00000590625
  CDS Start-End: 218-580
actgccgcggccctgctgctcagggcacatgcctcccctccccaggccgcggcccagctgaccctcggggctcccccggcagcggacagggaagggttaaaggcccccggctccctgccccctgccctggggaacccctggccctgtggggacatgaactagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatc

SEQ ID NO: 143791 - DNA, 1201 bp, Homo sapiens
  Payload ID: 8415
  Gene Symbol: IL11
  Gene Name: interleukin 11
  Uniprot ID: P20809
  ENST ID: ENST00000585513
  CDS Start-End: 154-753
actgccgcggccctgctgctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatc

SEQ ID NO: 143792 - DNA, 650 bp, Homo sapiens
  Payload ID: 8415
  Gene Symbol: IL11
  Gene Name: interleukin 11
  ENST ID: ENST00000587093
  CDS Start-End: 531-650
gcccgcctggccctgcgacctgcccgcgggcgttccaccctgggacttaagacctccagctccatcctccctaaggccgggagtccaggccccagaccctcctccccgagacccaggagtccagaccccaggccttcctccctcagacctaggagtccaggcccccagcctctcctccctcagacccaggaggagtccagaccccagttcctcctccctcagacccgggagtccaggcccaggccctcctctctcagacccggagtccagcctgagctctctgccttatcctgcccccaggtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctg

SEQ ID NO: 143793 - DNA, 1728 bp, Homo sapiens
  Payload ID: 8416
  Gene Symbol: IL11RA
  Gene Name: interleukin 11 receptor, alpha
  Uniprot ID: Q14626
  ENST ID: ENST00000318041
  CDS Start-End: 66-1334
gggggctgtagctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttggagatta

SEQ ID NO: 143794 - DNA, 1700 bp, Homo sapiens
  Payload ID: 8416
  Gene Symbol: IL11RA
  Gene Name: interleukin 11 receptor, alpha
  Uniprot ID: Q14626
  ENST ID: ENST00000441545
  CDS Start-End: 43-1311
gagggcgagggcagagggcgctggcggcagcggccgcggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttgga

SEQ ID NO: 143795 - DNA, 539 bp, Homo sapiens
  Payload ID: 8416
  Gene Symbol: IL11RA
  Gene Name: interleukin 11 receptor, alpha
  ENST ID: ENST00000466082
  CDS Start-End: 1-233
gaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctgactgagataacccacattgttggagagacagctgcctttctatgccccaggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctg

SEQ ID NO: 143796 - DNA, 575 bp, Homo sapiens
  Payload ID: 8416
  Gene Symbol: IL11RA
  Gene Name: interleukin 11 receptor, alpha
  ENST ID: ENST00000556792
  CDS Start-End: 157-575
agagggggcggggcagggaaggggaaggaggggatggctctggggtcccagaactgagtggagtaggagacgggggctgtagctggtgagaggaagtcctagaggctatggacactctgctgctgggatcaccgaggtagggtggggctaagcaggatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggttt

SEQ ID NO: 143797 - DNA, 3008 bp, Homo sapiens
  Payload ID: 8416
  Gene Symbol: IL11RA
  Gene Name: interleukin 11 receptor, alpha
  Uniprot ID: Q14626
  ENST ID: ENST00000555003
  CDS Start-End: 1357-2625
atctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaaggggcgggtagggagtgtgtagggagcgtgtacgtggctttgtgtccttggctcctccagactctcacatgtgcgggcaccatatacttctgctgcccttgtgccccaatcattgcacaaacagaaacagctctgacagagaagggactgctagagttaggaaccctagggcctggaaggaaggtatggctctcagagtgacctggggtctattcagtcccctctggacctgtttccctggcaacgctgtgggaacaacagtctatgcaacacaggagacctgatgccactggtgtcctccaaattttaaggcgaaggcaggcattgtgaatgatgcagggatggccagaatggtttttgccttcgttctttccccaggggaaccaagcctgtgggtggggaaatcacactaaggctggacagtgactgaatctggcccaggagaaacttggctgcctgccttccagaccagggtttttcttccctgagatcctggaggggaagtacctggaacttgggagtgttgccctggtctggaagatctgatagacatagtatgcacacatttccctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagtt

SEQ ID NO: 143798 - DNA, 944 bp, Homo sapiens
  Payload ID: 8416
  Gene Symbol: IL11RA
  Gene Name: interleukin 11 receptor, alpha
  ENST ID: ENST00000555981
  CDS Start-End: 135-944
gtgatttctaacagccttaccccacttggtgcatcaatttttctcctaggaagcctcagttttggagaggaagagccaggctttagcctcccatctcaggggtcggggatttttgactctacctctccccacagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacg

SEQ ID NO: 143799 - DNA, 1669 bp, Homo sapiens
  Payload ID: 8416
  Gene Symbol: IL11RA
  Gene Name: interleukin 11 receptor, alpha
  ENST ID: ENST00000555247
  CDS Start-End: 73-237
cgggagggagtagaggccggggcagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccagggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttgga

SEQ ID NO: 143800 - DNA, 537 bp, Homo sapiens
  Payload ID: 8416
  Gene Symbol: IL11RA
  Gene Name: interleukin 11 receptor, alpha
  ENST ID: ENST00000556531
  CDS Start-End: 37-537
aaagcactgggtatacagtgggaaaggggacctcagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccc

SEQ ID NO: 143801 - DNA, 1505 bp, Homo sapiens
  Payload ID: 8416
  Gene Symbol: IL11RA
  Gene Name: interleukin 11 receptor, alpha
  ENST ID: ENST00000557298
  CDS Start-End: 55-261
ctggtgagaggaagtcctagaggctatggacactctgctgctgggatcaccgagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggctgaggctgagacggggtgggaaggatggatccccaaagcctgggttcttggcctcagtgattccagtggacaggcgtccaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttg

SEQ ID NO: 143802 - DNA, 491 bp, Homo sapiens
  Payload ID: 8416
  Gene Symbol: IL11RA
  Gene Name: interleukin 11 receptor, alpha
  ENST ID: ENST00000553620
  CDS Start-End: 35-491
gggcagagggcgctggcggcagcggccgcggaagatgagcagcagctgctcagggctgagcagggtcctggtggccgtggctacagccctggtgtctgcctcctccccctgcccccaggcctggggccccccagaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtac

SEQ ID NO: 143803 - DNA, 1388 bp, Homo sapiens
  Payload ID: 8416
  Gene Symbol: IL11RA
  Gene Name: interleukin 11 receptor, alpha
  Uniprot ID: Q14626
  ENST ID: ENST00000602473
  CDS Start-End: 1-1173
atgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctcttgcacttggagtcccagccagatcagcggtttacccacccgctacctcacctcctacaggaagaagacagtcctaggagctgatagccagaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatcttgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtggagccagctggactggaggaggtgatcacagatgctgtggctgggctgccccatgctgtacgagtcagtgcccgggactttctagatgctggcacctggagcacctggagcccggaggcctggggaactccgagcactgggaccataccaaaggagataccagcatggggccagctacacacgcagccagaggtggagcctcaggtggacagccctgctcctccaaggccctccctccaaccacaccctcggctacttgatcacagggactctgtggagcaggtagctgtgctggcgtctttgggaatcctttctttcctgggactggtggctggggccctggcactggggctctggtaagtgactgccattggtccctcagcctctgatcctcacacatgctctgatgcccatagaccacattcatctccacccttcatgactgcccgctgaacctgtctgattctggaactacctccccatacctccatcccccatgccccacttgattttaactgattcctctcctgaccctttactaataaaccctttggcggagactgagataacccaca

SEQ ID NO: 143804 - DNA, 1902 bp, Homo sapiens
  Payload ID: 8417
  Gene Symbol: IL12RB1
  Gene Name: interleukin 12 receptor, beta 1
  Uniprot ID: P42701
  ENST ID: ENST00000322153
  CDS Start-End: 110-1255
tcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagatggcatgatctcagctcactgcaacctccgccttccagattcaagagattctcctgcttcagcctcccgagtagctgggattacaggcatctgccaccatacccggctaattttgtatttttagtagagacggggtttcaccacgttggccaggctggtctcgaactcctgacctcaagtgatccacctgccttggcctcccaaagtgttgggattataggcgtgagccaccatgcccagcctaatttttgtatttttagtagagatggagtttcaccatgttgcccaggctggtctcaaactcctgccctcaggtgatccacccacctcagcctctcaaagtgctgggattacaggtgtgagccactgtggccgacctactatttttattatttttgagctaggttctcagtctgttggcagactggagtgcaatcatggctcactgcagccttgaactcccagactcaagtgatccttccacctcagcctctggagtagctgggactacagacatgcaccaccacacctggttaattttttatttttattttttgtagagacaggtgtctctctacgttgcccaggctggtctcgaactcctgggctcaagtgatccacccatctccacctcccaaagtgctaggattacaggcgtgagccaccgtacccagcctggtcccatatcatagtgaaatggtgcctgtaaagctctcagcattggcttggcacatgcagttggtactcaataaacggctgttgctatcccca

SEQ ID NO: 143805 - DNA, 528 bp, Homo sapiens
  Payload ID: 8417
  Gene Symbol: IL12RB1
  Gene Name: interleukin 12 receptor, beta 1
  ENST ID: ENST00000430026
  CDS Start-End: 174-528
actttgacttgccttagggatgggctgtgacactttactttttttcttttttcttttttttcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggatctcttccaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctggg

SEQ ID NO: 143806 - DNA, 595 bp, Homo sapiens
  Payload ID: 8417
  Gene Symbol: IL12RB1
  Gene Name: interleukin 12 receptor, beta 1
  ENST ID: ENST00000598019
  CDS Start-End: 394-595
agaacactccgctgcctctccagagccaggcacacagcaggcgctccataaatgttcgttggatgatcctcagcgacgttagggtctcttgccacatggagggaagctcggccctcctcctcgggctgaaggtctctctccctgagaaggcggaagctgaggagcagctgccaggcagaggccactggggaacaacaacaatgactaatcacactggccagcgggtggacagcgctcactgcaagccaagccctccttcatactcacaaaagcccattttgcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagg

SEQ ID NO: 143807 - DNA, 2901 bp, Homo sapiens
  Payload ID: 8417
  Gene Symbol: IL12RB1
  Gene Name: interleukin 12 receptor, beta 1
  Uniprot ID: P42701
  ENST ID: ENST00000600835
  CDS Start-End: 300-2288
ggtcaggcgcctccttcacttgctgtgagtcccttatcacaactgatcactccgtggggtcaccgctgctctggcgtctacctcccccaacaggttggggtttctaggagggcagctccagaggttgcagaacactccgctgcctctccagagccaggcacacagcaggcgctccataaatgttcgttggtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaactttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattca

SEQ ID NO: 143808 - DNA, 2782 bp, Homo sapiens
  Payload ID: 8417
  Gene Symbol: IL12RB1
  Gene Name: interleukin 12 receptor, beta 1
  Uniprot ID: P42701
  ENST ID: ENST00000593993
  CDS Start-End: 181-2169
ctctttcactttgacttgccttagggatgggctgtgacactttactttttttcttttttcttttttttcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaactttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattca

SEQ ID NO: 143809 - DNA, 557 bp, Homo sapiens
  Payload ID: 8417
  Gene Symbol: IL12RB1
  Gene Name: interleukin 12 receptor, beta 1
  ENST ID: ENST00000594176
  CDS Start-End: 403-557
acttgctgtgagtcccttatcacaactgatcactccgtggggtcaccgctgctctggcgtctacctcccccaacaggttggggtttctaggagggcagctccagaggttgcagaacactccgctgcctctccagagccaggcacacagcaggcgctccataaatgttcgttggcagctgccaggcagaggccactggggaacaacaacaatgactaatcacactggccagcgggtggacagcgctcactgcaagccaagccctccttcatactcacaaaagcccattttgcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatg

SEQ ID NO: 143810 - DNA, 4040 bp, Homo sapiens
  Payload ID: 8418
  Gene Symbol: IL12RB2
  Gene Name: interleukin 12 receptor, beta 2
  Uniprot ID: Q99665
  ENST ID: ENST00000262345
  CDS Start-End: 641-3229
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 143811 - DNA, 2454 bp, Homo sapiens
  Payload ID: 8418
  Gene Symbol: IL12RB2
  Gene Name: interleukin 12 receptor, beta 2
  Uniprot ID: Q99665
  ENST ID: ENST00000371000
  CDS Start-End: 220-2199
agagagcgcggagagcgcgacacgtgcggcccagagcaccggggccacccggtccccgcaggcccgggaccgcgcccgctggcaggcgacacgtggtcacggtgatccatttgtaaagtcgggaataaatgacctctgaagtgttgtctgtatattgatctgctaccagtaaaacatatctctgaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaagagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagc

SEQ ID NO: 143812 - DNA, 687 bp, Homo sapiens
  Payload ID: 8418
  Gene Symbol: IL12RB2
  Gene Name: interleukin 12 receptor, beta 2
  ENST ID: ENST00000441640
  CDS Start-End: 1-687
acagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaaggtgagttttaagcgtcaacttaaaactcaagggaataaaactgaagg

SEQ ID NO: 143813 - DNA, 3782 bp, Homo sapiens
  Payload ID: 8418
  Gene Symbol: IL12RB2
  Gene Name: interleukin 12 receptor, beta 2
  Uniprot ID: Q99665
  ENST ID: ENST00000544434
  CDS Start-End: 641-2971
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 143814 - DNA, 3849 bp, Homo sapiens
  Payload ID: 8418
  Gene Symbol: IL12RB2
  Gene Name: interleukin 12 receptor, beta 2
  ENST ID: ENST00000541374
  CDS Start-End: 641-2548
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 143815 - DNA, 1522 bp, Homo sapiens
  Payload ID: 8419
  Gene Symbol: IL12A
  Gene Name: interleukin 12A
  Uniprot ID: P29459
  ENST ID: ENST00000305579
  CDS Start-End: 308-1069
acggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaatt

SEQ ID NO: 143816 - DNA, 1283 bp, Homo sapiens
  Payload ID: 8419
  Gene Symbol: IL12A
  Gene Name: interleukin 12A
  ENST ID: ENST00000466512
  CDS Start-End: 104-823
cgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 143817 - DNA, 863 bp, Homo sapiens
  Payload ID: 8419
  Gene Symbol: IL12A
  Gene Name: interleukin 12A
  ENST ID: ENST00000480787
  CDS Start-End: 104-751
cgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattac

SEQ ID NO: 143818 - DNA, 2761 bp, Homo sapiens
  Payload ID: 8420
  Gene Symbol: IL12B
  Gene Name: interleukin 12B
  Uniprot ID: P29460
  ENST ID: ENST00000231228
  CDS Start-End: 457-1443
gggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccctgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 143819 - DNA, 1283 bp, Homo sapiens
  Payload ID: 8421
  Gene Symbol: IL13
  Gene Name: interleukin 13
  Uniprot ID: P35225
  ENST ID: ENST00000304506
  CDS Start-End: 15-455
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacagttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctagcacttggagccaagggttcagagactcagggccccagcactaaagcagtggacaccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttccttgtatttaaatattaaatatgttagcaaagagttaatatatagaagggtaccttgaacactgggggaggggacattgaacaagttgtttcattgactatcaaactgaagccagaaataaagttggtgacagata

SEQ ID NO: 143820 - DNA, 498 bp, Homo sapiens
  Payload ID: 8421
  Gene Symbol: IL13
  Gene Name: interleukin 13
  ENST ID: ENST00000617259
  CDS Start-End: 57-491
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacagttcaacaacttcgaaagcatcattatttgcagagacaggacctgactattga

SEQ ID NO: 143821 - DNA, 1096 bp, Homo sapiens
  Payload ID: 8422
  Gene Symbol: IL13RA1
  Gene Name: interleukin 13 receptor, alpha 1
  Uniprot ID: P78552
  ENST ID: ENST00000371642
  CDS Start-End: 38-877
ggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggcct

SEQ ID NO: 143822 - DNA, 4036 bp, Homo sapiens
  Payload ID: 8422
  Gene Symbol: IL13RA1
  Gene Name: interleukin 13 receptor, alpha 1
  Uniprot ID: P78552
  ENST ID: ENST00000371666
  CDS Start-End: 68-1351
agagggagcgaaggaggcggggactgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcacccaaa

SEQ ID NO: 143823 - DNA, 1371 bp, Homo sapiens
  Payload ID: 8423
  Gene Symbol: IL13RA2
  Gene Name: interleukin 13 receptor, alpha 2
  Uniprot ID: Q14627
  ENST ID: ENST00000243213
  CDS Start-End: 126-1268
gtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttg

SEQ ID NO: 143824 - DNA, 1498 bp, Homo sapiens
  Payload ID: 8423
  Gene Symbol: IL13RA2
  Gene Name: interleukin 13 receptor, alpha 2
  Uniprot ID: Q14627
  ENST ID: ENST00000371936
  CDS Start-End: 251-1393
taaaaatttgatcctaagattctataaagtagccattgaggcttaccaaagttacaatattacagatggatcaggggagacggttgctatggagatggatgatatcataactccattgtgaaccagtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaa

SEQ ID NO: 143825 - DNA, 2472 bp, Homo sapiens
  Payload ID: 8424
  Gene Symbol: IL15
  Gene Name: interleukin 15
  Uniprot ID: P40933
  ENST ID: ENST00000296545
  CDS Start-End: 845-1333
actccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggaggtacagagctcggcttctttgccttgggaggggagtggtggtggttgaaagggcgatggaattttccccgaaagcctacgcccagggcccctcccagctccagcgttaccctccggtctatcctactggccgagctgccccgccttctcatggggaaaacttagccgcaacttcaatttttggtttttcctttaatgacacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagaatccattccaatatatggccatgtggctctttggagcaatgttccatcatgttccatgctgctgacgtcacatggagcacagaaatcaatgttagcagatagccagcccatacaagatcgtattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaa

SEQ ID NO: 143826 - DNA, 1447 bp, Homo sapiens
  Payload ID: 8424
  Gene Symbol: IL15
  Gene Name: interleukin 15
  Uniprot ID: P40933
  ENST ID: ENST00000320650
  CDS Start-End: 372-860
gggactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgacgtcacatggagcacagaaatcaatgttagcagatagccagcccatacaagatcgtattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaa

SEQ ID NO: 143827 - DNA, 1545 bp, Homo sapiens
  Payload ID: 8424
  Gene Symbol: IL15
  Gene Name: interleukin 15
  Uniprot ID: P40933
  ENST ID: ENST00000394159
  CDS Start-End: 1-408
atggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcacctt

SEQ ID NO: 143828 - DNA, 1388 bp, Homo sapiens
  Payload ID: 8424
  Gene Symbol: IL15
  Gene Name: interleukin 15
  Uniprot ID: P40933
  ENST ID: ENST00000514653
  CDS Start-End: 647-1054
cctgcagccaggactcgatggagaatccattccaatatatggccatgtggctctttggagcaatgttccatcatgttccatgctgctgacgtcacatggagcacagaaatcaatgttagcagatagccagcccatacaagatcgttttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgc

SEQ ID NO: 143829 - DNA, 1355 bp, Homo sapiens
  Payload ID: 8424
  Gene Symbol: IL15
  Gene Name: interleukin 15
  Uniprot ID: P40933
  ENST ID: ENST00000529613
  CDS Start-End: 592-1080
cacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagtttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcgattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttg

SEQ ID NO: 143830 - DNA, 6026 bp, Homo sapiens
  Payload ID: 8424
  Gene Symbol: IL15
  Gene Name: interleukin 15
  Uniprot ID: P40933
  ENST ID: ENST00000477265
  CDS Start-End: 5009-5416
catttgatgtgtccatcattcccttttgctggatatacttcccttgactgacttctagaatatgatactcttcattttccccttattcagtagtcattccttttgatttttctttcctggtccttcttttataatccttgacctaattaatactgaagtatcccatgctcaggttttggtccttttctctacctacatcactccctcatgagcactctgatgagttgcatatctatttccagttcagacacattcctgaactcgagatttatgtatccaatggcatatttgatatttccttgtgcatatctaatgagcctttcaaactcagcatgtccagaactgaaactcctgacctgtcccctctcctcaaggcatcagctgtgtccaaggcttgcttttttcagttgatgtcagctccatcttctcaggtgttcagaggaaaagactcagagtcattctcattctctttttcctcctgtaccctgcaatctgtctggaaattatattagtcctatcataaaaaatgattccagactctaaccacatgtatctatctccactgctaccccaagcagattcaggtcctcctctcctccacctttctgacctcatctcagactactcttgcccttgctcattccactggcttcttttctgtcccttagactcatagccacacagttgcctctgccctagctattccctctgcttcaaatagtcttcactgagataccaccggggctcacaccctttctatctttaccctgactacccaaaatttcaacctcacccttcttaccttgtttcctttttcctagataatttttcactctctaataaaatacataattataataacttatttgtgcattttctatatggttcatctttctttctgaaatcaagattgtgttctgccatcattgatgtattccaaggtcataaaaaatgcctagcccataataaatattcagtgaatatttactaaatgaatcaaggaaagtgatgttgtcttatagtctctatattctattcagtctcggcttgtcttttctagtggtttgaatgaatggatgatgcatttaacccagaaaaccaatacttgtaaatcttttattcttgtatgtttaattaattttaaatgtgtgattagacaagttaataagcagaacaaaacatcaagtatgttagatcatctttcctcactgggaagaactataatattggtatagaatgtaagatgtttacagttattttcacaagcaatgatttgcttgggaaatagcaatggtgtgagccccgacagtatctgggtgaagaatatttgaagcagaaggaaaatctagagcagaggcaactgtgtgactacgagtctaagggacagttttcactccagaatgaaaactatagagatgcctgcctgcgttaacttgctcacctcactatgtattttccctgggcagtaccatcctgctaggatttcagtgctgccatgagtcagcagtcaccttgcagtgagatccaatcacaagattccaaacaattcctaccctgtgagctccttgaggacagggctgggatttagtctcttttatttcacaggcccagagttctaggatggcagaatggtttcgggtgccaggccccacctggttgctctccatgggcatactgcccagggctgccttgggacttggctccctacattttggtgcagcagtcttcagccaccccaactatggcttaagtggccccagctgcagcttgacccactgcttcacaagatacaggtggtaagccttggtgaaattcatgtagtgttaagcctgcagtctcacagaatacaagagctgagggggcatggcttcctccactttgatttcaaaagatgatgctgacttatttggggcacaggcagagactttgcacaggggtagaaccaccacagagagcccccaacagggcggtgcctcatggagccaaggaaatggggttgccaccaaaatcctagaattatggttaacagtgtagagctgcagtctggaaaagcttcaggcatgagactccaacccatgacagctgaagaataggctgagcctaggaaagctatgggagctgagctgcctgaggccttaggggtccaacccccacccagtgtgcccaggatgcagaatatggagtgaaaggaaattattctccaactttaagatttaatattgttctccctgttgggttttggacttgtttcagatgagttatccctcttttcttgcctatttccccattttagaatgggaatgtctcttctataccttcgcacattgtattttggaagcagatagcttattttgatttcacaggctcgtggttgcagaacatttgccttcaggatgaagtcacacccatatttgatttagataagtattacctagataactcgattaactagatttagataagtattaactaacagtattaagagttaatactggagtgacttttgagcctactaggatggaatgaatatattttgcattgtatgaaggatgtgaatttggcagagaggggagggtaggtgcagaatgctatggtttgaatgcctccaccaaaactcatgttgacatttaattgtgaatgtgacagttttaagaagtgggatctttaacaggtaattaggtatctctttaggcactttcattagacagggccctcatgaatggattaatgcagttatggagggagtgagtttgttattgcatgagtgggctccttattaaagggtgattttggctcagtttcctctctgtctcatgtgcttgctttcacttctacccttctgccacaggatgacccttagcagatgtcagtgccatgcacttgtacttcccagcctccagaactgtgagccaaatgagcttgtgtcccttgtaaattaagtttgtggtgttctcttatagcagcagaaaatggattcaggcagcaagcagagctataaaatacttctttttttttttttttgagatggagtttcacttttgttgcccaggctgtagtgcaaaggcatgatctcggctcaccacaacctctttctcccgggttcaagcaattgtctggcctcagcctcccgagtagctgggattacaggcatgcactatcacacccggctgattttgtatttttttgtaaagacggggtttcaccatgttggtcaggctgatctcaaactcccgacatcaggtgatcctcctgcctcggcctcccaaactgctgggattacaggcacgagccaccatgcccggccaatacttcttttcatctacactggcttccattatcatgattttgttagatacttttgaggacattttctattgcattcctccatgtttggcaaccacactctatggtggagtcttctggctaagcacttagtcttcttttacttataccagcaggatgtagttgagcagggtagtgaaaatccattgtgacattgtaaagcctcactgctataagaggccaggaatgaaattttcattgtttacaaaagtagcttcgtaaggcctaattaagaattatatcacccatggcattgctcaatcccaagtcaatattttttttttttgaaaaatgtggattcaaggataccacaactaaaagggatgtagggaatttaagaggctttggatgaaatgatgaagattacggtaaagttttataaaaaatttgaagcactgagataatatagacaaagggaataattataaaatgagagtgataaggaaggtttgctttaaataaaccaatcaatgagtgatttagatcatatgtaacaggaatattagatttgatatgttcttgtggacaaaaaggtatttctattggatacacctttgtatcttgcttaatacctaaataagtgttagctttttctttctatgagttatagacaatacattttaaagcagccattttttatatttcagaaacatctgaaaagtataataatttaattctttgtgtttatggaacttaattcagtgaatatttatgtcatgggttgtggcagattttggttttttgtggaagaggtcaccatgtatatactattttgaagggcagaaaatagttgtttctatttttgtatattttggttataaactgcttttaatggcatggagttgaatttagggatgtttaatcttcatattcttcacttgatttgagtgagaaaaaataaaattttcttggttataaaattctcaaatgattaacaatggtttctttaaaagactgaagatacatattcagtggctgtagaaatggctactgctattgtaaactggattaacaatcagtacttctacaaatctaagtatttgtttgtttttactttttactagtatgactctggaatttttcaattcagggaaataatagaatagaaaagctttgctaaggcattgtaatcagacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggc

SEQ ID NO: 143831 - DNA, 588 bp, Homo sapiens
  Payload ID: 8425
  Gene Symbol: IL15RA
  Gene Name: interleukin 15 receptor, alpha
  Uniprot ID: Q13261
  ENST ID: ENST00000379971
  CDS Start-End: 16-480
tgtggagctgccgccatggccccgcggcgggcgcgcggctgccggaccctcggtctcccggcgctgctactgctgctgctgctccggccgccggcgacgcgggagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttgatttgagggcaaccccctcctcttttcaaaacctatgaaccacctgctttgcaggcaaactcccccgctggccagcgttgaaatggaagccatggaggctctgccggtg

SEQ ID NO: 143832 - DNA, 1626 bp, Homo sapiens
  Payload ID: 8425
  Gene Symbol: IL15RA
  Gene Name: interleukin 15 receptor, alpha
  Uniprot ID: Q13261
  ENST ID: ENST00000379977
  CDS Start-End: 99-902
tggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 143833 - DNA, 858 bp, Homo sapiens
  Payload ID: 8425
  Gene Symbol: IL15RA
  Gene Name: interleukin 15 receptor, alpha
  ENST ID: ENST00000397246
  CDS Start-End: 343-858
actggaggtcccagagcacgacgagcgcggaggaccgggaggctcccgggcttgcgtggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggcaggtagagaaggacagaagatcagtgtggagcagaacatggagaaaaagcctctgacactccagcaccagatagcaccagaggcctcaaagccagtggggctctgcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatg

SEQ ID NO: 143834 - DNA, 1799 bp, Homo sapiens
  Payload ID: 8425
  Gene Symbol: IL15RA
  Gene Name: interleukin 15 receptor, alpha
  ENST ID: ENST00000397248
  CDS Start-End: 15-1076
aaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcgggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgc

SEQ ID NO: 143835 - DNA, 584 bp, Homo sapiens
  Payload ID: 8425
  Gene Symbol: IL15RA
  Gene Name: interleukin 15 receptor, alpha
  Uniprot ID: Q13261
  ENST ID: ENST00000397250
  CDS Start-End: 31-540
agtccagcggtgtcctgtggagctgccgccatggccccgcggcgggcgcgcggctgccggaccctcggtctcccggcgctgctactgctgctgctgctccggccgccggcgacgcgggagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcct

SEQ ID NO: 143836 - DNA, 1046 bp, Homo sapiens
  Payload ID: 8425
  Gene Symbol: IL15RA
  Gene Name: interleukin 15 receptor, alpha
  ENST ID: ENST00000397251
  CDS Start-End: 120-1046
aaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcgggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagcttagatgccttcatcaaaatcagaggaggcttctccacgtggctgcttgggcttcctcacagcacggtgggctcaggctag

SEQ ID NO: 143837 - DNA, 759 bp, Homo sapiens
  Payload ID: 8425
  Gene Symbol: IL15RA
  Gene Name: interleukin 15 receptor, alpha
  Uniprot ID: Q13261
  ENST ID: ENST00000397255
  CDS Start-End: 1-759
atggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttga

SEQ ID NO: 143838 - DNA, 659 bp, Homo sapiens
  Payload ID: 8425
  Gene Symbol: IL15RA
  Gene Name: interleukin 15 receptor, alpha
  ENST ID: ENST00000435171
  CDS Start-End: 1-596
agcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagctcacagagaaaagtgacatacctgaggctctctgtcaattacaaggctcctcctggcgtgggagatgtctatagggaagacaccagcgtttgggctcctcccaatgaccctgtctccagctgtgctgcacgcactgacagggagccggaaaaggtggaggagatgctaagcccagtgaatcctctccatcgaaggattcaggaagaagaaaactcatctcagcgccattttacatatatatgcatttatacttccttgtctgttatatctacacattatatatgatttgtattttgacattgtgccttgtataaacaaaataaaatatatattttcaatattttaaaa

SEQ ID NO: 143839 - DNA, 547 bp, Homo sapiens
  Payload ID: 8425
  Gene Symbol: IL15RA
  Gene Name: interleukin 15 receptor, alpha
  ENST ID: ENST00000429135
  CDS Start-End: 31-547
agtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactg

SEQ ID NO: 143840 - DNA, 730 bp, Homo sapiens
  Payload ID: 8425
  Gene Symbol: IL15RA
  Gene Name: interleukin 15 receptor, alpha
  ENST ID: ENST00000453922
  CDS Start-End: 287-730
gggtcgcagggagagcgccgccgctgcgcccgggtcacccacgtaagggagcgggcggcctggctggggtctccgaggccgaggtcaggagcagttctgagaagcccgttttggccacgggagcgcggagccggcggcgtccagcagtttggagacacgggcgagtgcgcttctcccaggcgcctggactgcagggcgggtgttgcatagcacgcggtcctcggaggggtccgggagaaactactcctcccgactcccaggcaaaagcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactc

SEQ ID NO: 143841 - DNA, 906 bp, Homo sapiens
  Payload ID: 8425
  Gene Symbol: IL15RA
  Gene Name: interleukin 15 receptor, alpha
  ENST ID: ENST00000447291
  CDS Start-End: 1-467
ccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttgatttgagggcaaccccctcctcttttcaaaacctatgaaccacctgctttgcaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatt

SEQ ID NO: 143842 - DNA, 1850 bp, Homo sapiens
  Payload ID: 8425
  Gene Symbol: IL15RA
  Gene Name: interleukin 15 receptor, alpha
  Uniprot ID: Q13261
  ENST ID: ENST00000525219
  CDS Start-End: 432-1127
agctgcagcaggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttgcccactctcttcgcagtggggacaccggaccgagtgcacactggaggtcccagagcacgacgagcgcggaggaccgggaggctcccgggcttgcgtgggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgc

SEQ ID NO: 143843 - DNA, 679 bp, Homo sapiens
  Payload ID: 8425
  Gene Symbol: IL15RA
  Gene Name: interleukin 15 receptor, alpha
  ENST ID: ENST00000532039
  CDS Start-End: 1-629
gcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagaaccacagagataagcagtcatgagtcctcccacggcaccccctctcagacaacagccaagaactgggaactcacagcatccgcctcccaccagccgccaggtgtgtatccacagggccacagcgacaccactggaaggaagcaacacttgctaccagatttccaggcatccttccagagagactgtataaataaacatatagaggataaggaatgctggacagttgcttcttttctccttttcttggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgc

SEQ ID NO: 143844 - DNA, 1037 bp, Homo sapiens
  Payload ID: 8425
  Gene Symbol: IL15RA
  Gene Name: interleukin 15 receptor, alpha
  Uniprot ID: Q13261
  ENST ID: ENST00000528354
  CDS Start-End: 31-735
agtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctg

SEQ ID NO: 143845 - DNA, 660 bp, Homo sapiens
  Payload ID: 8425
  Gene Symbol: IL15RA
  Gene Name: interleukin 15 receptor, alpha
  Uniprot ID: Q13261
  ENST ID: ENST00000530685
  CDS Start-End: 1-660
atggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattaagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagggcctctgtctgctcctgccatccccgcagtgctggacatacatgctcagtgggaagcgtctgttga

SEQ ID NO: 143846 - DNA, 1037 bp, Homo sapiens
  Payload ID: 8425
  Gene Symbol: IL15RA
  Gene Name: interleukin 15 receptor, alpha
  ENST ID: ENST00000620865
  CDS Start-End: 120-1037
aaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcgggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactggaaggaagcaacacttgctaccagatttccaggcatccttccagagagactgtataaataaacatatagaggataaggaatgctggacagttgcttcttttctccttttctgtaccatgtttgtttccacttgctggtataccttgtag

SEQ ID NO: 143847 - DNA, 1115 bp, Homo sapiens
  Payload ID: 8425
  Gene Symbol: IL15RA
  Gene Name: interleukin 15 receptor, alpha
  ENST ID: ENST00000620345
  CDS Start-End: 120-1115
aaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcgggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggtggctggccaagagaagcctgcccggcgacgctgaggcaccgaacatgagcaggggaggaaggaatgcctgggagcagctgagccgagcccctgccaccagcctcctccgcacgcccgtggaatcagcactttctgcttcccgcccctga

SEQ ID NO: 143848 - DNA, 1070 bp, Homo sapiens
  Payload ID: 8425
  Gene Symbol: IL15RA
  Gene Name: interleukin 15 receptor, alpha
  ENST ID: ENST00000618528
  CDS Start-End: 120-1070
aaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcgggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagtgacagtgctgtaggaaagagtaagctggaaaaagagaaggttcagaacgacagtgctgacgcagacatcacacagcggtatgccagtgctatggtgcctgtttaa

SEQ ID NO: 143849 - DNA, 1160 bp, Homo sapiens
  Payload ID: 8425
  Gene Symbol: IL15RA
  Gene Name: interleukin 15 receptor, alpha
  ENST ID: ENST00000622442
  CDS Start-End: 120-1160
aaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcgggatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaagctctcactccagggagctcacactgcttaccttaaaatggcctaaagagctgctgctcctccggagggacatttcaccagccctggtagaaggtgccggccagatgcccagggcatcagcacccaggcagctccagacaggccagccacgtatgaccagtgtcctgcctcgcctgtgcttgtcattcgggagctga

SEQ ID NO: 143850 - DNA, 3999 bp, Homo sapiens
  Payload ID: 8426
  Gene Symbol: IL16
  Gene Name: interleukin 16
  Uniprot ID: Q14005
  ENST ID: ENST00000302987
  CDS Start-End: 1-3999
atggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctag

SEQ ID NO: 143851 - DNA, 2397 bp, Homo sapiens
  Payload ID: 8426
  Gene Symbol: IL16
  Gene Name: interleukin 16
  Uniprot ID: Q14005
  ENST ID: ENST00000394652
  CDS Start-End: 217-2112
ctgtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttatta

SEQ ID NO: 143852 - DNA, 9616 bp, Homo sapiens
  Payload ID: 8426
  Gene Symbol: IL16
  Gene Name: interleukin 16
  Uniprot ID: Q14005
  ENST ID: ENST00000394660
  CDS Start-End: 361-4356
acatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtgcatagggagggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccaagcactgtgctcagggctaaacgggcattgcctttagtgatcacagcagcttctacggtgtatggttctgtgccaatgtattgataagagggcacacactgtgtacagtaaatggcttatccagctggtgagtgatgcggcagattgagttttcttctgtgattcggtggagactatcagcccaagatgctttaagtgcacaacattacagggaatgcctgagtgcctggccaaagggatatttggtttggccatctctggatgcctgattgccaagctcaggaccaggcaatgtgactttgcatcagcaacaaccagcatcccttgaccaggcctgggccagagtattggtctcctctcagcccctgatcctgtgaagtaaggatgtgggggaagacctggcaaggacacagatgaaacacaaacaatagtaattctcaggccatcatcagtggagccatgttaatgtaatctgatggcttctccagggtccacaggaagtgaagaatctgtttcccagcagtggactcaaaacccatctgggctcctaaccttcctgtaaacccctttagtggcttcattagagcaggcgttcagctcactgttctattcatctcaaggaataatgggcttagagcagtttctgtcctgctggttaacttgtttggcctattccattctggattttgtcaagcagtagacaagcaattagacaagaacttggaggcaccatttgtatccactttttagacttaatagaaacattgaagatgaacataatctaccaacgaaagacgtgattcaattcaacactcccttcccatgacccaggctgggcaaggaggccacgtgatgtggagggcacattccttgcctgcacaaactcaccatctgtgcacgcagtggccttccctaaaatcagggaattgttttaagtcttatcaagcagccaagggatgaaagagaaggtgggttttcatcaagactggaaggtggggacagggatgagcatggagctggccgtgggcctggggtaccaagagactccttgagagaccaggcaaagcaagtgattgggacagaggttatctgtcccaggttatctgggcatagatgcaggtgagcccatggccctcccagtacctcctgtctctggcctgttttagaaggttctctcctccccaaggagacacaacaactcctagggccactgaagatataactattgcccaggtttctggtctctaggctggggaagtcctctgggtaggaatcagcaagaagatcctaaaacaaaagctcatccatttgcgttccatgatgctgggatttacacttgaggcttagctttgctctgccaacttcttcagagctgacacaggatgaaggcaatgccatcctcaaacactgcaggcatcacagctaacaattgtgaagtcgtcttaactcaccataaaaaggaatccactcccaggcagccctacttctttgctttgcccagcattttactgattcatacattatctcacttgtgccaacactcaagaagcaggctacactgacactggtattcctgcctccatattttctttaaaagacaaatcaaagcagatatattaagtgactgttcaagagcacacttggcccaagtggcagagcttggactggatgcatgttttccagctcctcatccagggctctgaccagtttaacctgatgcagtcacgtggaggagcagtgcaggcacagtatgtcccataggcccagtgagatgcattcttggttggctggccttccacttggctacacagggatgtacaaggcgatcccatcttgataagaccaccacctcagagtatggagctcagagagggcaggcatgaagtttccttggctggtgcacctagaattggctgaactcatgagaagttgatatagaacagtgcttgccacagagcggggactcggtaagcacttaatgaatgaatgaattctaagtcaatccaagagtctgatgatttcttgaaaagggtgttagctaaaggatcttaggcatgactgtagaatttgtagttgcaatagaacagagaaagaggaagctttctgtctccttaacactgagctgtcatgttttaaagcttgctcacatcttggcacatttaagagacagtcaccccaggactcaaaaatagggaagtaacagtaacgcaggggaaacgttttctgtttggaggagcaaaggctgagaacactgtgaaaacattttgcgcgcacaatagtaacctgggtaaatgcagcgtgaagggattttagtcacacgtggtctttcttacaaggaaggtggtgggggtgcagatgaggttgctagagaatgttagaggatccctctctggattggagatagggaaagaaagttgcacggctgctgaggccccttctaggtggcaaggctgtgctccctggttctgatgatgtgcctgggtggacatggcccctgtgagtttgtacagtcttgcagcaggatctagaggggggatttccagccagggctgctagacggaggcctactcttccatctttcctgatggcaggatggcctggccagggcctggaagacagagacctcctgcctccgcctcagtaagacgacaaggaaaggcaaatgcccaagggaaagaaaaggaaggctcttctccccagagttccccatgcagacatgagtgcgtgctcagttcagaatcacttctgagaactcatccctaatgctgcagatttgggctggaacagattcacactgtctggtttcaccgaggacatgaaactccaccttgcggggataaagagagaaaaacaaattcatcaaatggaagacacattgaaagtgtttttccttaatgcttatcctgtttttaaaccattatttccaagttgacaccttttttaaggaaaaataaatattttgcggcattaaagccatatacaaggtctatatcagaaaaatatatttggggggctgcagcacaggactgagggagcggtacatgcttaaaaggcaacagggcctggttttcagtggcgatgatgattctctatgacagtcagggaaacgtggtctctgagagtgatgggcacataaagccttggtgccagagtgcatcgcatggtgtccaggccgagtctctgtcagatggttagaggcctgggtctaccctgccaggagaggcgtgtttgggtaacaggcagatggagtttggaacacatgaatggctcatcacacgccaaccctgagtggggcaggaggcaggaagggtgggctgccgcctctggttggcattctcagagatgcgcagtccatcagcttgttccaaagagtgaacacaggcctctgcgtgctcccaggctccttggtgtcccaacagctggagctcctcgatgagtcacgggagttctttgccaagaagtaacgatagcattactcatggaattgcttcactgctttctgaaggttggcataaaaccgggtcatgctgcgggggaagaaggagtccaccacgttctgtgggaggtaaccgctgaggtcggtatggaagaatgtgaccaggttggtcttggtgggttccctgtgaaggcaacagcagagctgtgttatgatctgcagcagaggtgctggggacgagcgccaggcaggtgagcagagcccagcccagtggaaatggccatgatacagtgatcgcgtctcatcccttgctgtgccctccacccaggagtcctctctggacctgctgattttcaggatggaaacccatcctgtcggggatgcattccacagcctctcccggcctccagggaggaagaagtccctactcccagcccaaaaacccagtaccctgctgcccgattcactcagcaaatgctttcagagaactcactttgtgccaggccctgagaggaacgaagagatgctgcccttcactatttagggtctgcaacctcctgggggctcctgggaccctttcaaggggtctacaaagttaacactatttttataacaacacgaacatgtgattcgccttctctcacatgcatacagtggggttttccggaggttacatgatatgtgatattgcaacagactacacgcacaagcaggtatgagtttctgttaagcctggcatgaaagagatgggcaaaaatataaaaacaatgccactcttttcacagtattttttgttttaaaaaaatagttttttaaaataaaaatgttatctatgttaa

SEQ ID NO: 143853 - DNA, 2977 bp, Homo sapiens
  Payload ID: 8426
  Gene Symbol: IL16
  Gene Name: interleukin 16
  ENST ID: ENST00000560241
  CDS Start-End: 399-1763
catttgcttctcaaggagggcaggagttggaagcgaccgttgtgaaacgttaaagattttctggcagagggaaagggattttttttttctccctccctgccgaggaaaaaacagttctaacgaggagttactttgtagttttaactcatattcaaatactcccagccgagaagctgccatcgatcctcccatggacccctgatcctggtttggaggaacttttcacagctctctctccctccctcaaaccctgtgcaatgagtttgcagaagagagtcttcccgagaaggcagaacgggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacagaaggaagaaatggaggctcaggaggttaagtaacttgtctaggtgttcacacctagacagtagaggaaccgggactagaacacaagcctttttgactctaggactcatactcttaactattactccaaagtgataataaactgtctctgaacagcaactcaaagaagctgtggcccaggctgtggaaaacaccaagtttggaaaggagaggcatcagtggagtctggaagatgcagaaatggagttgggtcccccaggaagctgactctgagatggagtttggtctgcaggcagtgtcctggggttcactacctgtggcagggaggggagcaggcagggtagacagagggaggacggagctgaggtgcacacccaacagcttcagccaagccctggagctctgcagccaaagtccccattagagttgtcctatgttggccaacatagctgggcctctgtaaccctatctccagcagtccctggagatgggctgccccattggacaaggcagctgtctgcagctgtggcagcccctggagggacccacagctgaaagtagtctgccagcagcactccccacagctgggacaccaagcccttcctcgatgggtgatctgggtggcatatctccatatacatcagtcataggctcagaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgaggccagggggtatttctgttttctgaagctcagctgtgaagattctcttgtgcttcccacacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccag

SEQ ID NO: 143854 - DNA, 1922 bp, Homo sapiens
  Payload ID: 8426
  Gene Symbol: IL16
  Gene Name: interleukin 16
  ENST ID: ENST00000558857
  CDS Start-End: 1-135
agtgcctctgccggctgcccaggacctggtatcggcccacagaccaagtcctccacagagggcgagccagggtggagaagagccagcccagcttggaaactagaatttaggaagaaaagtcactgtatgatgtaatgcacagctttggccttgtttctgcactgtagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggtg

SEQ ID NO: 143855 - DNA, 2020 bp, Homo sapiens
  Payload ID: 8426
  Gene Symbol: IL16
  Gene Name: interleukin 16
  ENST ID: ENST00000558332
  CDS Start-End: 1-1835
agaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggtgtggggtgtgtctggttctttgcgtgctctccagttgtgggcatgtggccaggcccccaaaaggcttctgggcactttctgggctatgttgtttcccacaactccatgtcctcttcataggcatgctggtccttttagggctcaattctgctttttctactttttctcctttgctcagacatcccctcaatcccccctctgttttgatgggtcttcaaaaatacctaagtcctgggcttggttcgggttggcagggccaggactctagagtggggcagtgaggcactggcctgtggggcagaatt

SEQ ID NO: 143856 - DNA, 2158 bp, Homo sapiens
  Payload ID: 8426
  Gene Symbol: IL16
  Gene Name: interleukin 16
  ENST ID: ENST00000559383
  CDS Start-End: 377-2158
cacatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtgcatagggaggtaggtgggcaccagggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcc

SEQ ID NO: 143857 - DNA, 3775 bp, Homo sapiens
  Payload ID: 8426
  Gene Symbol: IL16
  Gene Name: interleukin 16
  ENST ID: ENST00000560115
  CDS Start-End: 1-604
gcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaagatgcagaaatggagttgggtcccccaggaagctgactctgagatggagtttggtctgcaggcagtgtcctggggttcactacctgtggcagggaggggagcaggcagggtagacagagggaggacggagctgaggtgcacacccaacagcttcagccaagccctggagctctgcagccaaagtccccattagagttgtcctatgttggccaacatagctgggcctctgtaaccctatctccagcagtccctggagatgggctgccccattggacaaggcagctgtctgcagctgtggcagcccctggagggacccacagctgaaagtagtctgccagcagcactccccacagctgggacaccaagcccttcctcgatgggtgatctgggtggcatatctccatatacatcagtcataggctcagaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgaggccagggggtatttctgttttctgaagctcagctgtgaagattctcttgtgcttcccacacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggggctaattctgaagtctcccatgaagaggatgcaatattggatgtgttgatgaaaagacaaaacacatttgtgctgttctaagttgtaaagctgcattgactgcagttggtatcacatgtggctgcctgtaaaagagctaacaattcatgaatgtcaacagatgtcaacttacagagctcccaaccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggtg

SEQ ID NO: 143858 - DNA, 5120 bp, Homo sapiens
  Payload ID: 8426
  Gene Symbol: IL16
  Gene Name: interleukin 16
  ENST ID: ENST00000360547
  CDS Start-End: 190-1644
agtttgcagaagagagtcttcccgagaaggcagaacgagggtgtgtggagcactgcgggcgagatggagctgagggaaggcagagctgggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaagatgcagaaatggagttgggtcccccaggaagctgactctgagatggagtttggtctgcaggcagtgtcctggggttcactacctgtggcagggaggggagcaggcagggtagacagagggaggacggagctgaggtgcacacccaacagcttcagccaagccctggagctctgcagccaaagtccccattagagttgtcctatgttggccaacatagctgggcctctgtaaccctatctccagcagtccctggagatgggctgccccattggacaaggcagctgtctgcagctgtggcagcccctggagggacccacagctgaaagtagtctgccagcagcactccccacagctgggacaccaagcccttcctcgatgggtgatctgggtggcatatctccatatacatcagtcataggctcagaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgaggccagggggtatttctgttttctgaagctcagctgtgaagattctcttgtgcttcccacacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgaca

SEQ ID NO: 143859 - DNA, 2018 bp, Homo sapiens
  Payload ID: 8426
  Gene Symbol: IL16
  Gene Name: interleukin 16
  Uniprot ID: Q14005
  ENST ID: ENST00000559388
  CDS Start-End: 15-1697
agaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggaagatgtcggcagggctgggcttcagcctggaaggagggaagggctccctacacggagacaagcctctcaccattaacaggattttcaaaggtgtggggtgtgtctggttctttgcgtgctctccagttgtgggcatgtggccaggcccccaaaaggcttctgggcactttctgggctatgttgtttcccacaactccatgtcctcttcataggcatgctggtccttttagggctcaattctgctttttctactttttctcctttgctcagacatcccctcaatcccccctctgttttgatgggtcttcaaaaatacctaagtcctgggcttggttcgggttggcagggccaggactctagagtggggcagtgaggcactggcctgtggggcagaatt

SEQ ID NO: 143860 - DNA, 8607 bp, Homo sapiens
  Payload ID: 8427
  Gene Symbol: IL17RA
  Gene Name: interleukin 17 receptor A
  Uniprot ID: Q96F46
  ENST ID: ENST00000319363
  CDS Start-End: 134-2734
ctgggcccgggctggaagccggaagcgagcaaagtggagccgactcgaactccaccgcggaaaagaaagcctcagaacgttcgttcgctgcgtccccagccggggccgagccctccgcgacgccagccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaaaaaaaaaaaagatggtcacgcgggatgtaaacgctgaatgggccaggtgcagtggctcatgcttgtaatcccagcactttgggaaggcgaggcaggtggattgcttgagctcaggagttcaagaccagcctgggcgacatagtgagacctcatctctacctaaatttttttttagtcagtcatggtggcacatgcctgtagtcccagctactcgggaggctgatgccagatgatcacttgagcccaggaggtagaggctgcagtgagctataatggtaccattgcaatccagcctgggcagcagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtggggggtggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttcacttaccatacaatccacaattgaccctgcacaatttgatgccggtttagtatagtcacagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcaccaagaaatgtctctctaagaacaggtgccctccacgctgtgcccctcccacctcttcagctcgtctcctgagtgtgcagaggtggttccggttgggaaagaagcagcggagcatctaaccatgcctgtgtccaggccgattatgcacgcagccaccaacaagctcccaactcccgcgtagagtttcatgactttttcctgcctactatcttgatcctagttttttttttgttttttttttttttaaggaataattactttgattcaaaaccagtttctcttttctgcataggaaggtccttgaaggtgtttagggtctaaaaagggtggtgttcggtctctgaaacatccattcagcagtttgagctgggatctctgaatgcaagggtatgatggatatacttctttcttgcttttgttgtgttttggttttttgtttgtttttaagtcagggtctctctgtcaccaggctgtattacagtggtgcaatcatggctcactgcagcctcgacctcccaggctcaagccatctttccacctcagcctgccagtggctagaactacaggcgtgcaccactgtgcccggctaatttgtgtgtatatattttgtagaaatggggtttcaccatgttgtccaggctggtcacgaactcctgggctcaagccatctgcccgcctcatcctcccaaagtgctgggattataggcctgagcccaccgtgcctggcctttcctgtttatctttgaaaattaaatagggcataagagagaagaagatgtacttacaatgcagtgggtggttttaactctatagcctttgggctctgtggttggtgctccccttcctaaataaatgaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggctctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgcttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgttacaattatatatgtcttaggggaaaggaccatttcacatgtgtcacctcatgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacgcctgcttagcatttggcacagccagaagcagcaagctagggtcacaacacagagaggggctgtgtaatactggctgcctctgtgctaagaaaaaaaaaaaatcactgtgtgtttgtttattttggtgcaggcccagtgttcttgcttagacttaatactacccttcatgttaaaataaaaccaaacaaaaaccca

SEQ ID NO: 143861 - DNA, 8506 bp, Homo sapiens
  Payload ID: 8427
  Gene Symbol: IL17RA
  Gene Name: interleukin 17 receptor A
  Uniprot ID: Q96F46
  ENST ID: ENST00000612619
  CDS Start-End: 134-2632
ctgggcccgggctggaagccggaagcgagcaaagtggagccgactcgaactccaccgcggaaaagaaagcctcagaacgttcgttcgctgcgtccccagccggggccgagccctccgcgacgccagccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaaaaaaaaaaaagatggtcacgcgggatgtaaacgctgaatgggccaggtgcagtggctcatgcttgtaatcccagcactttgggaaggcgaggcaggtggattgcttgagctcaggagttcaagaccagcctgggcgacatagtgagacctcatctctacctaaatttttttttagtcagtcatggtggcacatgcctgtagtcccagctactcgggaggctgatgccagatgatcacttgagcccaggaggtagaggctgcagtgagctataatggtaccattgcaatccagcctgggcagcagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtggggggtggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttcacttaccatacaatccacaattgaccctgcacaatttgatgccggtttagtatagtcacagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcaccaagaaatgtctctctaagaacaggtgccctccacgctgtgcccctcccacctcttcagctcgtctcctgagtgtgcagaggtggttccggttgggaaagaagcagcggagcatctaaccatgcctgtgtccaggccgattatgcacgcagccaccaacaagctcccaactcccgcgtagagtttcatgactttttcctgcctactatcttgatcctagttttttttttgttttttttttttttaaggaataattactttgattcaaaaccagtttctcttttctgcataggaaggtccttgaaggtgtttagggtctaaaaagggtggtgttcggtctctgaaacatccattcagcagtttgagctgggatctctgaatgcaagggtatgatggatatacttctttcttgcttttgttgtgttttggttttttgtttgtttttaagtcagggtctctctgtcaccaggctgtattacagtggtgcaatcatggctcactgcagcctcgacctcccaggctcaagccatctttccacctcagcctgccagtggctagaactacaggcgtgcaccactgtgcccggctaatttgtgtgtatatattttgtagaaatggggtttcaccatgttgtccaggctggtcacgaactcctgggctcaagccatctgcccgcctcatcctcccaaagtgctgggattataggcctgagcccaccgtgcctggcctttcctgtttatctttgaaaattaaatagggcataagagagaagaagatgtacttacaatgcagtgggtggttttaactctatagcctttgggctctgtggttggtgctccccttcctaaataaatgaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggctctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgcttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgttacaattatatatgtcttaggggaaaggaccatttcacatgtgtcacctcatgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacgcctgcttagcatttggcacagccagaagcagcaagctagggtcacaacacagagaggggctgtgtaatactggctgcctctgtgctaagaaaaaaaaaaaatcactgtgtgtttgtttattttggtgcaggcccagtgttcttgcttagacttaatactacccttcatgttaaaataaaaccaaacaaaaacccat

SEQ ID NO: 143862 - DNA, 2010 bp, Homo sapiens
  Payload ID: 8428
  Gene Symbol: IL17RB
  Gene Name: interleukin 17 receptor B
  Uniprot ID: Q9NRM6
  ENST ID: ENST00000288167
  CDS Start-End: 10-1518
ggcccggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctacatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccactttta

SEQ ID NO: 143863 - DNA, 1048 bp, Homo sapiens
  Payload ID: 8428
  Gene Symbol: IL17RB
  Gene Name: interleukin 17 receptor B
  ENST ID: ENST00000494338
  CDS Start-End: 5-1048
ggcgatgtcgctcgtgctgctaagcctggccgcgctgtgcaggagcgccgtaccccgagagccgaccgttcaatgtggctctgaaactgggccatctccagagtggatgctacaacatgatctaatccccggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctacatcggcttccctgtagagctgaacacagtctatttcattggggcccataatattcctaatgcaaatatgaatgaagatggcccttccatgtctgtgaatttcacctcaccaggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcagctgactccatattttcctacttgtggcagcgactgcatccgacataaaggaacagttgtgctctgcccacaaacaggcgtccctttccctctggataacaacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatc

SEQ ID NO: 143864 - DNA, 2621 bp, Homo sapiens
  Payload ID: 8429
  Gene Symbol: IL17RC
  Gene Name: interleukin 17 receptor C
  Uniprot ID: Q8NAC3
  ENST ID: ENST00000295981
  CDS Start-End: 219-2594
aaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccggtgagtctggaaccctggggagacgaggaaaggctcagggttcagtttttggctcagcaaagccttagcctggctcctgtcactgctgccactgccagaactgccctgtctggtctgtctggtgctgatggtagaagagaagaacggggaaggggcaagagctgggtctgtctttctctgggagggtctgggaatacggagccccagaaaaagggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccc

SEQ ID NO: 143865 - DNA, 2384 bp, Homo sapiens
  Payload ID: 8429
  Gene Symbol: IL17RC
  Gene Name: interleukin 17 receptor C
  Uniprot ID: Q8NAC3
  ENST ID: ENST00000383812
  CDS Start-End: 243-2360
acagccagcagcctgccgggagccaaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttcta

SEQ ID NO: 143866 - DNA, 2388 bp, Homo sapiens
  Payload ID: 8429
  Gene Symbol: IL17RC
  Gene Name: interleukin 17 receptor C
  Uniprot ID: Q8NAC3
  ENST ID: ENST00000403601
  CDS Start-End: 198-2360
ggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccca

SEQ ID NO: 143867 - DNA, 1053 bp, Homo sapiens
  Payload ID: 8429
  Gene Symbol: IL17RC
  Gene Name: interleukin 17 receptor C
  ENST ID: ENST00000451165
  CDS Start-End: 219-494
aaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctggggtgccaccaaattctgggcttggaacagcttcagctcccacccgctcctccacacacagacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattca

SEQ ID NO: 143868 - DNA, 949 bp, Homo sapiens
  Payload ID: 8429
  Gene Symbol: IL17RC
  Gene Name: interleukin 17 receptor C
  ENST ID: ENST00000424206
  CDS Start-End: 183-653
gtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcagg

SEQ ID NO: 143869 - DNA, 946 bp, Homo sapiens
  Payload ID: 8429
  Gene Symbol: IL17RC
  Gene Name: interleukin 17 receptor C
  ENST ID: ENST00000434756
  CDS Start-End: 219-515
aaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgt

SEQ ID NO: 143870 - DNA, 2342 bp, Homo sapiens
  Payload ID: 8429
  Gene Symbol: IL17RC
  Gene Name: interleukin 17 receptor C
  ENST ID: ENST00000416074
  CDS Start-End: 243-2315
acagccagcagcctgccgggagccaaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccc

SEQ ID NO: 143871 - DNA, 2147 bp, Homo sapiens
  Payload ID: 8429
  Gene Symbol: IL17RC
  Gene Name: interleukin 17 receptor C
  Uniprot ID: Q8NAC3
  ENST ID: ENST00000413608
  CDS Start-End: 1-2124
atgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttct

SEQ ID NO: 143872 - DNA, 1354 bp, Homo sapiens
  Payload ID: 8429
  Gene Symbol: IL17RC
  Gene Name: interleukin 17 receptor C
  ENST ID: ENST00000412901
  CDS Start-End: 219-947
aaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctggtgaggcctcccccttcccaagtccattcccactgtaggccgatgcctgtgcaaaggacgcagtgccatatcagagaggatccttgaagaggactcaccccaagcaagggaaaattgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgca

SEQ ID NO: 143873 - DNA, 1445 bp, Homo sapiens
  Payload ID: 8429
  Gene Symbol: IL17RC
  Gene Name: interleukin 17 receptor C
  ENST ID: ENST00000436503
  CDS Start-End: 198-1445
ggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcaggtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtca

SEQ ID NO: 143874 - DNA, 2244 bp, Homo sapiens
  Payload ID: 8429
  Gene Symbol: IL17RC
  Gene Name: interleukin 17 receptor C
  Uniprot ID: Q8NAC3
  ENST ID: ENST00000455057
  CDS Start-End: 154-2220
aactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagggtggctgaggctcttgaaacaggacgtccgctcgggggcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttcta

SEQ ID NO: 143875 - DNA, 2163 bp, Homo sapiens
  Payload ID: 8429
  Gene Symbol: IL17RC
  Gene Name: interleukin 17 receptor C
  ENST ID: ENST00000451231
  CDS Start-End: 219-590
aaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccc

SEQ ID NO: 143876 - DNA, 2284 bp, Homo sapiens
  Payload ID: 8429
  Gene Symbol: IL17RC
  Gene Name: interleukin 17 receptor C
  ENST ID: ENST00000451271
  CDS Start-End: 192-404
aggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgactgcagggggctcgaagtctggaacagcatcccgagctgctgggccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtgaacagctcggagaagctgcagctgcaggagtgcttgtgggctgactccctggggcctctcaaagacgatgtgctactgttggagacacgaggcccccaggacaacagatccctctgtgccttggaacccagtggctgtacttcactacccagcaaagcctccacgagggcagctcgccttggagagtacttactacaagacctgcagtcaggccagtgtctgcagctatgggacgatgacttgggagcgctatgggcctgccccatggacaaatacatccacaagcgctgggccctcgtgtggctggcctgcctactctttgccgctgcgctttccctcatcctccttctcaaaaaggatcacgcgaaagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttcta

SEQ ID NO: 143877 - DNA, 772 bp, Homo sapiens
  Payload ID: 8429
  Gene Symbol: IL17RC
  Gene Name: interleukin 17 receptor C
  ENST ID: ENST00000440502
  CDS Start-End: 162-461
agtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatggtgagcaagtcatcctgtgacagtgcatgtgtacacggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcc

SEQ ID NO: 143878 - DNA, 1208 bp, Homo sapiens
  Payload ID: 8429
  Gene Symbol: IL17RC
  Gene Name: interleukin 17 receptor C
  ENST ID: ENST00000438091
  CDS Start-End: 219-1208
aaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgggcctctcctgccgcctctgggacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgcctctgtattcaggtgtggcctctggaacctgactccgttaggacgaacatctgccccttcagggaggacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacaaggttctcgagttcccattgctgaaaggccaccctaacctctgtgttcag

SEQ ID NO: 143879 - DNA, 1044 bp, Homo sapiens
  Payload ID: 8429
  Gene Symbol: IL17RC
  Gene Name: interleukin 17 receptor C
  ENST ID: ENST00000476810
  CDS Start-End: 192-326
aggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccgaactgccctgtctggtctgtctggtgctgatggtagaagagaagaacggggaaggggcaagagctgggtctgtctttctctgggagggtctgggaatacggagccccagaaaaagggcctctcctgccgcctctgggtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatgggcactgggaagagcctgaagatgaggaaaagtttggaggagcagctgactcaggggtggaggagcctaggaatgcctctctccaggcccaagtcgtgctctccttccaggcctaccctactgcccgctgcgtcctgctggaggtgcaagtgcctgctgcccttgtgcagtttggtcagtctgtgggctctgtggtatatgactgcttcgaggctgccctagggagtgaggtacgaatctggtcctatactcagcccaggtacgagaaggaactcaaccacacacagcagctgcctgccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctggtgaggcctcccccttcccaagtcc

SEQ ID NO: 143880 - DNA, 8720 bp, Homo sapiens
  Payload ID: 8430
  Gene Symbol: IL17RD
  Gene Name: interleukin 17 receptor D
  Uniprot ID: Q8NFM7
  ENST ID: ENST00000296318
  CDS Start-End: 90-2309
gcggccgccgcggccaccgcccactcggggctggccagcggcgggcggccggggcgcagagaacggcctggctgggcgagcgcacggccatggccccgtggctgcagctctgctccgtcttctttacggtcaacgcctgcctcaacggctcgcagctggctgtggccgctggcgggtccggccgcgcgcggggcgccgacacctgtggctggaggggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacttgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagtccaacttcctagttttgtttaattagtttcactttttctactctccccagtatgctagaaatgggaatcgttgccctgcagattacggcaaaacatctgttttaagcaaagctgcattttttgactcagaaattgtcccagacggtggatataagatgaaattcagaaaaacgttctgccaagtcacaggcttttagatattatggaaacaagaaatggaaaacaggatgatctccatgagaggccttgatcctgagagtaaaaggcttgtgtagataggttagacaacgtcctctagaaaagagaccagggataagtccaggtttccaggaaaaccaagaagcctgcgggtagctgaaggtagagtgctagttgttcatcttaacttaccaatgagctacagaaaggacttagcatctgatgtcatcagctttgccaggagagtgatcaaggaggttaaagctcaggtaaaggtgtgccttctcagagattggctacaagcaacagagaccacctcaacagagaccacctcaacagactcagcccagccatacaaggtgccaaagctcctccagagggctgtcttgggcctttgaggcaattgatctccagaaagagtcagaagtcattccagtccaggcccaggtattcagatggtgacccagccagataatagtatcttgagcaaataatagtatcttgagtgcaaataagcaggaagactgtccttcaaaaaatgtggggttacatgattttcagagcctttttttcagagttgagcatcttttcttttaaaagaaataaggggcaagaggaccaattttattccttgaggaaaaatgacacacccttctcccaaaagaaagaaaactctctggccccccaacttcaacactaatttggctccctgaagaagagagaaaatattatttctgtctttattgaagagaaatgggcaatgccaatgtgaaggttactagtcttttttattttctattggtgaagactactactgctcttatttagcagatcttataccttcagtggtcaccagtatagcaggtgaggtataaggaaaacagcagtgtgatgataaatggtaattaatatactttgtctgtgtcagcaatagggaatggtggggactgtggcaaactgaagcgcccctgttccacccacagtgggtaattttccagtcgactgtggccatgaagtacttcctgatcttcccatttttcaagaaaagctgacaatctggatttttatatgaaaaattctgattttaaaaaatattggcaactaagttaaaattcaagtgaatttagacccagcagaagacatggatggacctgatttggtccactgactaccagtttgttaacctgtgctttataagatttgaaggaaaggcattcatggtaattacagacggtgccaccagaaaatgctcttgctaaatgcagccagtagttagattgcttctttctccagtctcccccgcaaagaaatttgacgtgattctgaatgcactggacatgtcttgattgcgtctttacatttcacagtgtcttaaaagaaaggcaagccagttgttaatttcagaatcagatttatgctctctcaatttaaaaaatgctgggaacaatttcatttttttttttttgagatggagtcttgctctgttgcccaggctggagtgcagtggcgtgatctcggctcactgcaagctccacctcccgggttcacgccattctcctgcctcagcctcctgagtagctgggactacaggcgcccaccaccacgcctggctaatttttttgtatttttagtagagacggggtttcactgtgttagccaggatgatctcgatctcctgacctggtgatccgcttgcctcggcctcccaaagtgctgggattacaggcgtgagccactgcgcccggcctaacaatttcatttaaactccacaacctaaagggctttgtttatagttttagctcttggcataatttttttcaggtggtgtgcaattctgagcataggccaagacatgattaggaaagcaggcagttgtagagagtaaggcaaggaacctcctagcgtccattagagccaggtatttgcattatcttccgttttaagtggtctgtgaattgactgtgttttggaggtgtgaaacagtatacagagaaaagcttttcctgatactgagatatcagttaggagtccaaatggggtgttgggtcatccttgccatatcacctcctttccaggctcagagtgaaaatagacaaaaggaaatctgactgcaagccagtggctttgattccagtttcagagtttagggactaggagagagtttagattatctagcatattctccccctggtgtcagacagggctgtgcctgaattattccagacatatggctgtagatggtattctttattttataagaaggagattctgtaacctaccctgctgatcagatagttctttgtatgtcttagagaaattcaagccagcttccttttgttcggcttgtagtggagaaagaacagctggtcaccttccatgtattcaaaaaccacagtgaagtcatccccctggtgtttttatttcagtgataaataattccacccacttaaaccattcttcatggctcttgttttccaggggcctaataattttcactgctgtaatgtttctcagcttcacacttagtttagttgcccaaacaatgttggtgccttactcacattggtgccttgtgaagacgaggctcaggatggggattatggggaaattcttgcacacccagctcctcttaccacttaaaaatataatggcactttcacaaaatgatatgtcacctatattcattgagaattatttgactgccacatttttcccctgatgatagtcatctatcataacttgtgtttgttttcctcctgagatcaaacacttggtgcttattcctgatgtatactctgagaccagctcttaccttctgagtggcagctacccctccctcccaattttagatcctatttttacacatctctatagatatcacctttatttcatgactcacaatattaaatggtacagacttcagtttaaccactggtgtggtaacagcagtagttgctaagtaccaccttcccattgctgtttgagggctaatttgcaaagacatttgaatctcccagtgaagatgtctggggaattttggccagttgtcttccctcttgcccttttgttctttaaaattcagcttggaccatagacacctccaggatcttgtttatgttctgctctcaattgaccaagcactgcgttttgcacaatcagaagtctcacaaaagcaaacagttatgactgcatatctgatgtttatatcctataaaatttcaggaagattcagagtcaatcttctatttgtacatgatgtagacaaaattagctgctccaattgttagacaaaaaattgccattggattacactaatgtgctcatctgttgttttaaaagtttggtatcaggcggggcacggtggctcacgcctgtaatcccagcattttgggaggccaaggtgggcggatcacctgaggtccagagttcaagaccagcctgaccaacatggtgaaaccctgtctctactaaaaatacaaaattaatcaggcgtggttgtgtgtgcctgtaatcccagctactcgagaggctgaggcaggagaatcgcttgaatccgggaggcagaggttgcagtgagctgagatcacgccattgcactctagcctgggcaacaagagcgaaactccgtctcaacaacaacaacaaaaagtttggtatgtttctctcaagaaaaaagcatggtgagtccagacagcagcaaaagcttttgtgaaaaccaattgtgttcatctagatagtaagtaactcctatttttactgttaattttttaaaagagaatttttccctgtggaaactccctgttagtacgtcctaggggagaaagcctgtggaatatggtggttattgatggcgttgcctttgtttcatctttgagtttgccctttgtgggatctagtgggataatgagcactgacagaactcttaacagcgtgctgtatttttgacattgaaaatgttaatgacttgatttgtacataactctgtaactaggtgaaagtagatcacagctgacatttacaaaatgtttttgtaccttagaatttctgcattaaataaaatgttttgttttaa

SEQ ID NO: 143881 - DNA, 4474 bp, Homo sapiens
  Payload ID: 8430
  Gene Symbol: IL17RD
  Gene Name: interleukin 17 receptor D
  Uniprot ID: Q8NFM7
  ENST ID: ENST00000320057
  CDS Start-End: 544-2331
atccgctcttcttttcctccgggaaaagaaacgggaagtggccgtgggccggtgaattccgtgtagtggccaagctttgttccaaagagggggaggtggtgacagtctcttgcccactgaagcgtgccagacagagtgctaggcatgggggcagaggtgaatcagatgacagccacctctcaccacgaggagtggctgaaagtgtgactggactacaggcaatcctggccttggcagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacttgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagtcaccttttatgaaatgagtctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcagataagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataccgagtaatgaaaccatagtgtgattgcctcagaataaattgagaagtcc

SEQ ID NO: 143882 - DNA, 2348 bp, Homo sapiens
  Payload ID: 8430
  Gene Symbol: IL17RD
  Gene Name: interleukin 17 receptor D
  Uniprot ID: Q8NFM7
  ENST ID: ENST00000463523
  CDS Start-End: 346-2133
gcctcaggtgttcctgcgttgtttgtcagtggagagcagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccatgcaccgcacaacttcggcttccgtttcttctatcttcactacaagctcaagcacgaaggacctttcaagcgaaagacctgtaagcaggagcaaactacagagacgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacttgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgcccctttgtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaa

SEQ ID NO: 143883 - DNA, 589 bp, Homo sapiens
  Payload ID: 8430
  Gene Symbol: IL17RD
  Gene Name: interleukin 17 receptor D
  ENST ID: ENST00000467210
  CDS Start-End: 370-589
ttttcctccgggaaaagaaacgggaagtggccgtgggccggtgaattccgtgtagtggccaagggagtggggccagccagcagaaacagtgggctgtacaacatcaccttcaaatatgacaattgtaccacctacttgaatccagtggggaagcatgtgattgctgacgcccagaatatcaccatcagccagtatgcttgccatgaccaagtggcagtcaccattctttggtccccaggggccctcggcatcgaattcctgaaaggatttcgggtaatactggaggagctgaagtcggagggaagacagtgccaacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtcct

SEQ ID NO: 143884 - DNA, 2704 bp, Homo sapiens
  Payload ID: 8431
  Gene Symbol: IL17RE
  Gene Name: interleukin 17 receptor E
  Uniprot ID: Q8NFR9
  ENST ID: ENST00000383814
  CDS Start-End: 106-2109
cgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaa

SEQ ID NO: 143885 - DNA, 2808 bp, Homo sapiens
  Payload ID: 8431
  Gene Symbol: IL17RE
  Gene Name: interleukin 17 receptor E
  ENST ID: ENST00000383815
  CDS Start-End: 84-644
gttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggctagcagctggagcagacacaaacccacctgggaagaattccctagccagtggggactcccctctcccccagctccatgcttcactcagctccccgggaggagaagatgcctggctcataggggtggggggctctgtgccctcaggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaag

SEQ ID NO: 143886 - DNA, 2757 bp, Homo sapiens
  Payload ID: 8431
  Gene Symbol: IL17RE
  Gene Name: interleukin 17 receptor E
  Uniprot ID: Q8NFR9
  ENST ID: ENST00000454190
  CDS Start-End: 86-1687
gtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctgctccatgcttcactcagctccccgggaggagaagatgcctggctcataggggtggggggctctgtgccctcaggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaagaaaa

SEQ ID NO: 143887 - DNA, 571 bp, Homo sapiens
  Payload ID: 8431
  Gene Symbol: IL17RE
  Gene Name: interleukin 17 receptor E
  ENST ID: ENST00000454992
  CDS Start-End: 52-571
accttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaag

SEQ ID NO: 143888 - DNA, 2158 bp, Homo sapiens
  Payload ID: 8431
  Gene Symbol: IL17RE
  Gene Name: interleukin 17 receptor E
  ENST ID: ENST00000421412
  CDS Start-End: 19-2121
ggtgcgtcccccaacctgatgctagcccctttcctgttacttctcacccacagcaggagccccttgtctttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgc

SEQ ID NO: 143889 - DNA, 952 bp, Homo sapiens
  Payload ID: 8431
  Gene Symbol: IL17RE
  Gene Name: interleukin 17 receptor E
  ENST ID: ENST00000444427
  CDS Start-End: 86-658
gtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacgaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagagatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcct

SEQ ID NO: 143890 - DNA, 2541 bp, Homo sapiens
  Payload ID: 8431
  Gene Symbol: IL17RE
  Gene Name: interleukin 17 receptor E
  ENST ID: ENST00000434065
  CDS Start-End: 86-526
gtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaact

SEQ ID NO: 143891 - DNA, 3500 bp, Homo sapiens
  Payload ID: 8432
  Gene Symbol: IL17REL
  Gene Name: interleukin 17 receptor E-like
  Uniprot ID: Q6ZVW7
  ENST ID: ENST00000341280
  CDS Start-End: 98-1108
ctcacccctctcactgttctgtccccagggctttgcctgcaggagccacaggaaccggaacatttttaacagcttctgccggccacgccccgtgtccatgtccaggtcagtcctggaggccctgacgtcctccactgccatgcagtgtgtcccctctgacggctgcgcgatgctcctgcgtgtacgcgcctccatcaccctgcatgagcgcctgcggggcctggaggcctgtgccatgagcctggacacccaggagacgcagtgtcagagcgtgtgggtggccagggcctcccaccggcagcagggggggcagcagctccaagtgcactttggctgctttgcggtgagcgtggcccagcacctctatgtcaccctgaggaccatccctcatttctgcggggtccagctggaccagaggcacctcgtggaagcggggaagctcagctactgggtggaccggaggcgcaaggcgattctggtgcaagtgcccagggcctccgggagccccgactactacctgcggctctgcctcaagcggttcacctgcgaggacgccggcgcccctgtgcgagtgaccgccaacagcgtctcccaggccgtcttcctgccctacagccaggagctgccgtgcctgtgcctggagggctggtctgcgacccctgacgcggtgcggatccagatctgcccctttgaaaacgacactgaggcactggaggtgctgtgggacacggtctactaccacccggagagccagacactgagctgggagcccgcctgccctgtgagtggccatgtgagcctgtgctggcgcccggggccgggggccggctgccgtaagctgcagcaatccagccagctggtgcatcgcagagtgcagtacccgctggtggacacccagccccagctctgcctgaagttctctaccagttgggggtcctgggtgcggtgccctttcgaacagcgtcgcttcccaaccccgcccacttccaggtgcacctgtgtcacaggaggaagtcacagctccctgcctgccaacgcacactccaggccagcccgctcccttcagcctcaggtgacctggcagccgcccctgcttttgccttcctagaccttcccagggaggaggcctgtgccccaggcatctgcatccagggctggaggaccgatgtacacttctccgtcccccagcagctctgcaacctccgctccagtgggtgcccatctctcaggggccgcaggaggccgaggactagacctaggcctcccacggcaggctgggcgtggcgtgcactgaacaggagactgggtgggggaaacggggagaccatccggccctgagtcaggtcaggcttctgcgccaaacccaggtctgtgcccagcactgccctccagccttgcatttccctccaccacacaccgctgggcctcccgcacgcccaccctggtctcactgtcactggccttgcctcctcctccctgggggtccaccttccctgatcagagctctggttccaaccgccagtgacttgggatgtccctttgcccaccagccactgaggcccaggctcccaggacccagggtacatcaggacaggactctgcccagtggacagaactaagcacatgtggcctgggtgtggtcaggagcgtggctctgccttggagtccaggaagggtcagagctggcactcctacctgcacccctccctgtgagcaaaagagcttgcctagcttcgggtggggtgaaccgcaacagccacagaggtgggaggggtgggagggggtggataggacagcctggcacccagggcctctggagaccctttccagggagcaccagtgggccaggcaggggtctctggaatgtctcctcagctcagctgagccacagccatttcagggcagcctgctgcccacaggacatgcccagggccgtggcagtacccgcagaccttcagctcccccttctcccagcaagactttttggccaagcctaggtccccctccctagcaaaggtcacctccagcagatcacagactaaaggggcaatggccacctgctggtcaggtgtccctggggctggcacctgccactgtggagtgcccatgctatgctgggcaagtccacggccccagggacaggcctggaggcagcaggaggaccgggcctggctcaggtggggggatctgggggtcatacacactcctcttggggccagggtgggctcctccttcacttgtctgctgagcctccctgcagatggaaggctgctgtccacagccactggcaccccaggactgggcagccccctccccttccctcacatgtctcagcctcgcacagtgggggcagggctgggaggtggtgtcccagccagtaccacccctacgtctctctccagctgcacccacccacatgggacggcagcctgaggccaggaatctcctcacgaacaagtaggtgccagggacacattgctggggggcaggaggccaaggcacagcctcggacagctgagccaggcccccctccgagagtgtggggtgttctcacctgactgtggggcctaggcacctgctggctgtcctggggctacagctccatggggccctcaggggctctgggtcacataaaagaccttcagccctgtcctgagtcccctgggaacagcaggagctgggtgggctaccccttccccggatggcccaggtgctggaccccagcctccctctcagacaattcatggtcatggccactgtccctggccctgaagacaaggccctggcagctgcctggagcttccccagtgctctggggtgcagggtgcaaccccacccttcctgtagctgatcaggcccgaggtggtcaaggatcaccccagtttctgcccagggcaccccacactggctggagtccacctctcctgtctgtgcatccttgggtgctgagcttcactggggcacccgccccactcggacccctccagagggtctcagcttccccagatcccagccccactcacccagcaacggtcagtcacttcctgtggtctcagaggccacctgcctgggggccacctgctgggatgtgcggttctcagacattccaagtggcacatccaggtcccagccaggggtgcccagcagtggcctgtgcagtgggccatggggtcggcccttgaagacttctcgtgtgggtcacgtaggctctccggcttccccgctgagccaccctctggagcctggacatcgtctcacctgagtgctgtgcaggaccacatgcccagcctgtcccagcggtggtcgcaccccatctgcagatgcactcccaccgcagtctgggcccaggctgccctcttccagctggccgtgggccgctgggccttcttttccctcctgcaacagaggctgctatgtcccatagactggagagggggctgcagagcgagtaagtccccgccactcagtaaacattggtccaggggtagctgttaaaatgg

SEQ ID NO: 143892 - DNA, 3668 bp, Homo sapiens
  Payload ID: 8432
  Gene Symbol: IL17REL
  Gene Name: interleukin 17 receptor E-like
  Uniprot ID: Q6ZVW7
  ENST ID: ENST00000389983
  CDS Start-End: 266-1276
actgcacagccagatgctggctgggcaagcactcgcgttcttgggcctgacctggggcactttccagagcctggccatcccccggattacagaatgtggcctctcctgttctcagttacacagaatataagttgctgatttcccaggtttcggatcgttctgtctcccccttctcggaatgtgagctcctggagagggctttgcctgcaggagccacaggaaccggaacatttttaacagcttctgccggccacgccccgtgtccatgtccaggtcagtcctggaggccctgacgtcctccactgccatgcagtgtgtcccctctgacggctgcgcgatgctcctgcgtgtacgcgcctccatcaccctgcatgagcgcctgcggggcctggaggcctgtgccatgagcctggacacccaggagacgcagtgtcagagcgtgtgggtggccagggcctcccaccggcagcagggggggcagcagctccaagtgcactttggctgctttgcggtgagcgtggcccagcacctctatgtcaccctgaggaccatccctcatttctgcggggtccagctggaccagaggcacctcgtggaagcggggaagctcagctactgggtggaccggaggcgcaaggcgattctggtgcaagtgcccagggcctccgggagccccgactactacctgcggctctgcctcaagcggttcacctgcgaggacgccggcgcccctgtgcgagtgaccgccaacagcgtctcccaggccgtcttcctgccctacagccaggagctgccgtgcctgtgcctggagggctggtctgcgacccctgacgcggtgcggatccagatctgcccctttgaaaacgacactgaggcactggaggtgctgtgggacacggtctactaccacccggagagccagacactgagctgggagcccgcctgccctgtgagtggccatgtgagcctgtgctggcgcccggggccgggggccggctgccgtaagctgcagcaatccagccagctggtgcatcgcagagtgcagtacccgctggtggacacccagccccagctctgcctgaagttctctaccagttgggggtcctgggtgcggtgccctttcgaacagcgtcgcttcccaaccccgcccacttccaggtgcacctgtgtcacaggaggaagtcacagctccctgcctgccaacgcacactccaggccagcccgctcccttcagcctcaggtgacctggcagccgcccctgcttttgccttcctagaccttcccagggaggaggcctgtgccccaggcatctgcatccagggctggaggaccgatgtacacttctccgtcccccagcagctctgcaacctccgctccagtgggtgcccatctctcaggggccgcaggaggccgaggactagacctaggcctcccacggcaggctgggcgtggcgtgcactgaacaggagactgggtgggggaaacggggagaccatccggccctgagtcaggtcaggcttctgcgccaaacccaggtctgtgcccagcactgccctccagccttgcatttccctccaccacacaccgctgggcctcccgcacgcccaccctggtctcactgtcactggccttgcctcctcctccctgggggtccaccttccctgatcagagctctggttccaaccgccagtgacttgggatgtccctttgcccaccagccactgaggcccaggctcccaggacccagggtacatcaggacaggactctgcccagtggacagaactaagcacatgtggcctgggtgtggtcaggagcgtggctctgccttggagtccaggaagggtcagagctggcactcctacctgcacccctccctgtgagcaaaagagcttgcctagcttcgggtggggtgaaccgcaacagccacagaggtgggaggggtgggagggggtggataggacagcctggcacccagggcctctggagaccctttccagggagcaccagtgggccaggcaggggtctctggaatgtctcctcagctcagctgagccacagccatttcagggcagcctgctgcccacaggacatgcccagggccgtggcagtacccgcagaccttcagctcccccttctcccagcaagactttttggccaagcctaggtccccctccctagcaaaggtcacctccagcagatcacagactaaaggggcaatggccacctgctggtcaggtgtccctggggctggcacctgccactgtggagtgcccatgctatgctgggcaagtccacggccccagggacaggcctggaggcagcaggaggaccgggcctggctcaggtggggggatctgggggtcatacacactcctcttggggccagggtgggctcctccttcacttgtctgctgagcctccctgcagatggaaggctgctgtccacagccactggcaccccaggactgggcagccccctccccttccctcacatgtctcagcctcgcacagtgggggcagggctgggaggtggtgtcccagccagtaccacccctacgtctctctccagctgcacccacccacatgggacggcagcctgaggccaggaatctcctcacgaacaagtaggtgccagggacacattgctggggggcaggaggccaaggcacagcctcggacagctgagccaggcccccctccgagagtgtggggtgttctcacctgactgtggggcctaggcacctgctggctgtcctggggctacagctccatggggccctcaggggctctgggtcacataaaagaccttcagccctgtcctgagtcccctgggaacagcaggagctgggtgggctaccccttccccggatggcccaggtgctggaccccagcctccctctcagacaattcatggtcatggccactgtccctggccctgaagacaaggccctggcagctgcctggagcttccccagtgctctggggtgcagggtgcaaccccacccttcctgtagctgatcaggcccgaggtggtcaaggatcaccccagtttctgcccagggcaccccacactggctggagtccacctctcctgtctgtgcatccttgggtgctgagcttcactggggcacccgccccactcggacccctccagagggtctcagcttccccagatcccagccccactcacccagcaacggtcagtcacttcctgtggtctcagaggccacctgcctgggggccacctgctgggatgtgcggttctcagacattccaagtggcacatccaggtcccagccaggggtgcccagcagtggcctgtgcagtgggccatggggtcggcccttgaagacttctcgtgtgggtcacgtaggctctccggcttccccgctgagccaccctctggagcctggacatcgtctcacctgagtgctgtgcaggaccacatgcccagcctgtcccagcggtggtcgcaccccatctgcagatgcactcccaccgcagtctgggcccaggctgccctcttccagctggccgtgggccgctgggccttcttttccctcctgcaacagaggctgctatgtcccatagactggagagggggctgcagagcgagtaagtccccgccactcagtaaacattggtccaggggtagctgttaaaatgg

SEQ ID NO: 143893 - DNA, 1859 bp, Homo sapiens
  Payload ID: 8433
  Gene Symbol: IL17A
  Gene Name: interleukin 17A
  Uniprot ID: Q16552
  ENST ID: ENST00000340057
  CDS Start-End: 46-513
gcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagctctggggagcccacactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaacgaactttaagtatgagaaaagttcagcccaagtaaaataaaaactcaatcacattcaattccagagtagtttcaagtttcacatcgtaaccattttcgccc

SEQ ID NO: 143894 - DNA, 696 bp, Homo sapiens
  Payload ID: 8434
  Gene Symbol: IL17B
  Gene Name: interleukin 17B
  Uniprot ID: Q9UHF5
  ENST ID: ENST00000261796
  CDS Start-End: 52-594
ctggggttccaggcgggcagcagctgcaggctgaccttgcagcttggcggaatggactggcctcacaacctgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctgaatcacctggcccagaagccaggccagcagcccgagaccatcctccttgcacctttgtgccaagaaaggcctatgaaaagtaaacactgacttttgaaagcaa

SEQ ID NO: 143895 - DNA, 1044 bp, Homo sapiens
  Payload ID: 8435
  Gene Symbol: IL17C
  Gene Name: interleukin 17C
  Uniprot ID: Q9P0M4
  ENST ID: ENST00000244241
  CDS Start-End: 50-643
gccaggtgtgcaggccgctccaagcccagcctgccccgctgccgccaccatgacgctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccgtgtggacacggatgaggaccgctatccacagaagctggccttcgccgagtgcctgtgcagaggctgtatcgatgcacggacgggccgcgagacagctgcgctcaactccgtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtgaccgccgaggccgtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatcccc

SEQ ID NO: 143896 - DNA, 1861 bp, Homo sapiens
  Payload ID: 8436
  Gene Symbol: IL17D
  Gene Name: interleukin 17D
  Uniprot ID: Q8TAD2
  ENST ID: ENST00000304920
  CDS Start-End: 109-717
aaaatgttttcagctcctggaggcgaaaggtgcagagtcgctctgtgtccgtgaggccgggcggcgacctcgctcagtcggcttctcggtccgagtccccgggtctggatgctggtagccggcttcctgctggcgctgccgccgagctgggccgcgggcgccccgagggcgggcaggcgccccgcgcggccgcggggctgcgcggaccggccggaggagctactggagcagctgtacgggcgcctggcggccggcgtgctcagtgccttccaccacacgctgcagctggggccgcgtgagcaggcgcgcaacgcgagctgcccggcagggggcaggcccgccgaccgccgcttccggccgcccaccaacctgcgcagcgtgtcgccctgggcctacagaatctcctacgacccggcgaggtaccccaggtacctgcctgaagcctactgcctgtgccggggctgcctgaccgggctgttcggcgaggaggacgtgcgcttccgcagcgcccctgtctacatgcccaccgtcgtcctgcgccgcacccccgcctgcgccggcggccgttccgtctacaccgaggcctacgtcaccatccccgtgggctgcacctgcgtccccgagccggagaaggacgcagacagcatcaactccagcatcgacaaacagggcgccaagctcctgctgggccccaacgacgcgcccgctggcccctgaggccggtcctgccccgggaggtctccccggcccgcatcccgaggcgcccaagctggagccgcctggagggctcggtcggcgacctctgaagagagtgcaccgagcaaaccaagtgccggagcaccagcgccgcctttccatggagactcgtaagcagcttcatctgacacgggcatccctggcttgcttttagctacaagcaagcagcgtggctggaagctgatgggaaacgacccggcacgggcatcctgtgtgcggcccgcatggagggtttggaaaagttcacggaggctccctgaggagcctctcagatcggctgctgcgggtgcagggcgtgactcaccgctgggtgcttgccaaagagatagggacgcatatgctttttaaagcaatctaaaaataataataagtatagcgactatatacctacttttaaaatcaactgttttgaatagaggcagagctattttatattatcaaatgagagctactctgttacatttcttaacatataaacatcgttttttacttcttctggtagaattttttaaagcataattggaatccttggataaattttgtagctggtacactctggcctgggtctctgaattcagcctgtcaccgatggctgactgatgaaatggacacgtctcatctgacccactcttccttccactgaaggtcttcacgggcctccaggtggaccaaagggatgcacaggcggctcgcatgccccagggccagctaagagttccaaagatctcagatttggttttagtcatgaatacataaacagtctcaaactcgcacaattttttcccccttttgaaagccactggggccaatttgtggttaagaggtggtgagataagaagtggaacgtgacatctttgccagttgtcagaagaatccaagcaggtattggcttagttgtaagggctttaggatcaggctgaatatgaggacaaagtgggccacgttagcatctgcagagatcaatctggaggcttctgtttctgcattctgccacgagagctaggtccttgatcttttctttagattgaaagtctgtctctgaacacaattatttgtaaaagttagtagttcttttttaaatcattaaaagaggcttgctgaagga

SEQ ID NO: 143897 - DNA, 1285 bp, Homo sapiens
  Payload ID: 8436
  Gene Symbol: IL17D
  Gene Name: interleukin 17D
  ENST ID: ENST00000498088
  CDS Start-End: 1180-1285
tttgagtactgaaacctttattcccattttactggaaacaaagaacatgaacaatttactagtcagaaaaaaagtgttttataacccaaaacaaatatttgccaagagctgtaaattgcttaaatcgcttaaactggagatttcagtgagatttttagcagtagattactaagctccttagttatagaacattcaatgcataggaaagtgtttttcctacaaagcataactgaaatgtagtttaactaatggtttacaattcagtcaaataccaaagctgcaaaccatttagggagtcatcaattacatattttgtacactttcaaaaagcttacagctgggatgggttgtttattttcaaagcatgactgctttaaaatgatcatattctttagcctgccacctaggaagcattaagcatttacttgcagaatgaacaaacgagcacgttgtcttgtgttatgaagtatataatatagttcgttttagtttcttcattcgcagactatcaggctcatttcacgtgactgcttgcacttagaactgagttatcacggagtaggaactctccaacatcgtcgtcatagaccaagagatgcccatgaacagccatgaaagtgccagtcagggaagtattcagtgctttgttgtagagttgttggatagaggcacaggatcatttcatgttgttgaggagaaaggagcaacagcctcctcccaccttattaaaaatagagatttaaaaaaacctctaatttcctcgaagtacagaatctcaagaggtagctctaaggagaatccctctgggtttgagcgcattcctcttccagggggcctattcttggactgctttccttaatagagaaatctctctgagccaaaatcggcctcccccaattccatcctgtcggccccacttttctgcttcggagacttccaagccagtccccactcctccttcagccagtcgggcccgcacccgcgcccggcagggccagccctctcctcctcctgcgtggcgcagcacaggccctgagcgcgcgaccccaggccctgggcgccccgccgcatgctcgcggctggaagccccagtttgcgtggcccttcgggttattccgctcaagagccgccgcgtcgccccatctcggcgcgaatctgaaagcgctttcgggggagaagatgttgggggcactggtctggatgctggtagccggcttcctgctggcgctgccgccgagctgggccgcgggcgccccgagggcgggcaggcgccccgcgcggccgc

SEQ ID NO: 143898 - DNA, 535 bp, Homo sapiens
  Payload ID: 8436
  Gene Symbol: IL17D
  Gene Name: interleukin 17D
  ENST ID: ENST00000468605
  CDS Start-End: 1-271
gcggccgcggggctgcgcggaccggccggaggagctactggagcagctgtacgggcgcctggcggccggcgtgctcagtgccttccaccacacgctgcagctggggccgcgtgagcaggcgcgcaacgcgagctgcccggcagggggcaggcccgccgaccgccgcttccggccgcccaccaacctgcgcagcgtgtcgccctgggcctacagctcagtttccatcacctctaatcatccctggaggactcgtcctttgttcctggattaagccgggccacctgtcactcgctcaagccaagcttcccacgtggccagggacacttctgcgatcccatcagaggggaaaacttgatgtgtttcaagaatgccctggtgccaagcttctgcagagcagcacgcagaaaatgtgaagacaaaagaatgactgcccacaggaggcgcggcacagggcagaactctgctcggttgcttgtccgtgtttgaatctcctacgacccggcgaggtaccccaggtacctgcctgaagcctact

SEQ ID NO: 143899 - DNA, 850 bp, Homo sapiens
  Payload ID: 8437
  Gene Symbol: IL17F
  Gene Name: interleukin 17F
  Uniprot ID: Q96PD4
  ENST ID: ENST00000336123
  CDS Start-End: 109-600
atgattgctataaaactaacaggtactctcattgatagaacacaggcatacacaggaagatacattcacagaaagagcttcctgcacaaagtaagccaccagcgcaacatgacagtgaagaccctgcatggcccagccatggtcaagtacttgctgctgtcgatattggggcttgcctttctgagtgaggcggcagctcggaaaatccccaaagtaggacatacttttttccaaaagcctgagagttgcccgcctgtgccaggaggtagtatgaagcttgacattggcatcatcaatgaaaaccagcgcgtttccatgtcacgtaacatcgagagccgctccacctccccctggaattacactgtcacttgggaccccaaccggtacccctcggaagttgtacaggcccagtgtaggaacttgggctgcatcaatgctcaaggaaaggaagacatctccatgaattccgttcccatccagcaagagaccctggtcgtccggaggaagcaccaaggctgctctgtttctttccagttggagaaggtgctggtgactgttggctgcacctgcgtcacccctgtcatccaccatgtgcagtaagaggtgcatatccactcagctgaagaagctgtagaaatgccactccttacccagtgctctgcaacaagtcctgtctgacccccaattccctccacttcacaggactcttaataagacctgcacggatggaaacagaaaatattcacaatgtatgtgtgtatgtactacactttatatttgatatctaaaatgttaggagaaaaattaatatattcagtgctaatataataaagtattaataatttaaaaa

SEQ ID NO: 143900 - DNA, 1147 bp, Homo sapiens
  Payload ID: 8438
  Gene Symbol: IL18
  Gene Name: interleukin 18
  Uniprot ID: Q14116
  ENST ID: ENST00000280357
  CDS Start-End: 221-802
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtgaa

SEQ ID NO: 143901 - DNA, 795 bp, Homo sapiens
  Payload ID: 8438
  Gene Symbol: IL18
  Gene Name: interleukin 18
  Uniprot ID: Q14116
  ENST ID: ENST00000528832
  CDS Start-End: 214-795
gctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcagatggctctttgctttcattaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactag

SEQ ID NO: 143902 - DNA, 1090 bp, Homo sapiens
  Payload ID: 8438
  Gene Symbol: IL18
  Gene Name: interleukin 18
  Uniprot ID: Q14116
  ENST ID: ENST00000524595
  CDS Start-End: 178-747
gcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtg

SEQ ID NO: 143903 - DNA, 1354 bp, Homo sapiens
  Payload ID: 8439
  Gene Symbol: IL18BP
  Gene Name: interleukin 18 binding protein
  Uniprot ID: O95998
  ENST ID: ENST00000260049
  CDS Start-End: 105-689
aagcagctctggtgctgaagagagcactgcctccctgtgtgactggagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgg

SEQ ID NO: 143904 - DNA, 1606 bp, Homo sapiens
  Payload ID: 8439
  Gene Symbol: IL18BP
  Gene Name: interleukin 18 binding protein
  Uniprot ID: O95998
  ENST ID: ENST00000337131
  CDS Start-End: 356-940
tttcctgtggtgggttcacacgcagctagacacagctaacttgagtcttggagctcctagagggaagcttctggaaaggaaggctcttcaggacctcttaggagccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctaagcagctctggtgctgaagagagcactgcctccctgtgtgactggagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgga

SEQ ID NO: 143905 - DNA, 1720 bp, Homo sapiens
  Payload ID: 8439
  Gene Symbol: IL18BP
  Gene Name: interleukin 18 binding protein
  Uniprot ID: O95998
  ENST ID: ENST00000343898
  CDS Start-End: 150-641
acacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggggcttgctcaccaccttctccctggagagggcagaagaggtcacacgcagagactgctactacatcttactcacctgccaaggcttggtggccaacacccagaggaacaaattaaggaccgggaattaattcccaggggctccctggtgcccaaaggacaagagcttcca

SEQ ID NO: 143906 - DNA, 1788 bp, Homo sapiens
  Payload ID: 8439
  Gene Symbol: IL18BP
  Gene Name: interleukin 18 binding protein
  Uniprot ID: O95998
  ENST ID: ENST00000393703
  CDS Start-End: 538-1122
acctcagacatgcagctcctgtccacacttaatatatgcatgcattggatcacccagccctggtctttctgcctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgga

SEQ ID NO: 143907 - DNA, 1549 bp, Homo sapiens
  Payload ID: 8439
  Gene Symbol: IL18BP
  Gene Name: interleukin 18 binding protein
  Uniprot ID: O95998
  ENST ID: ENST00000393705
  CDS Start-End: 299-883
gaggaagtgctctcggtgtatttcctgtggtgggttcacacgcagctagacacagctaacttgagtcttggagctcctagagggaagcttctggaaaggaaggctcttcaggacctcttaggagccagtgtgaaggtgaaggaggaagcagatgcctgttcatatggaaacaaagacctggctgtgaagaggggaggcggacaccaaagtcctgacacttgggcgggacagaattgatctagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgga

SEQ ID NO: 143908 - DNA, 1037 bp, Homo sapiens
  Payload ID: 8439
  Gene Symbol: IL18BP
  Gene Name: interleukin 18 binding protein
  Uniprot ID: O95998
  ENST ID: ENST00000393707
  CDS Start-End: 59-406
agaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgagctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgga

SEQ ID NO: 143909 - DNA, 2172 bp, Homo sapiens
  Payload ID: 8439
  Gene Symbol: IL18BP
  Gene Name: interleukin 18 binding protein
  Uniprot ID: O95998
  ENST ID: ENST00000404792
  CDS Start-End: 923-1507
gccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatgg

SEQ ID NO: 143910 - DNA, 1201 bp, Homo sapiens
  Payload ID: 8439
  Gene Symbol: IL18BP
  Gene Name: interleukin 18 binding protein
  Uniprot ID: O95998
  ENST ID: ENST00000534583
  CDS Start-End: 385-969
atcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgcttcagttccactcccaggaactttgcctgtcccacgagggagtatgggagagagggactgccacacagaagctgaagacaacacctgcttcaggggaacacaggcgcttgaaaaagaaaagagagaacagcccataatgctcc

SEQ ID NO: 143911 - DNA, 4080 bp, Homo sapiens
  Payload ID: 8439
  Gene Symbol: IL18BP
  Gene Name: interleukin 18 binding protein
  ENST ID: ENST00000497194
  CDS Start-End: 1373-1972
ctccatggataactgcatgaccctgagagaaaacctccttagatttagcatcctaggttcctcacacgcctcaccctgaatcctggccctcccgcagccccagcgccatttgtcccatcagtgacaagattcatattctgatgtagactctgttgccagagccagtgttgagccagtccgcctcttccccgggaagtgcctgcccttccctcctgttagggttggctctcgagcttgtgtgccagttcctgggttggccgtgagagttctacagacaaggaggaagtgctctcggtgtatttcctgtggtgggttcacacgcagctagacacagctaacttgagtcttggagctcctagagggaagcttctggaaaggaaggctcttcaggacctcttaggagccaggtaggagtctgggactactagtgaacctagacctgtggctctggccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtgaagaggggaggcggacaccaaagtcctgacacttgggcgggacagaattgatctgtgagagactcatctagttcataccctaggtgaccctgggggtggcatgggggtagattagagatcccagtctggtatcctctggagagtaggagtcccaggagctgaaggtttctggccactgaactttggctaaagcagaggtgtcacagctgctcaagattccctggttaaaaagtgaaagtgaaatagagggtcggggcagtgctttcccagaaggattgctcggcatcctgcccttcccagaagcagctctggtgctgaagagagcactgcctccctgtgtgactgggtgagtccatattctctctttgggtctcaattttgccttccctaatgaaggggtaagattggactaggtaagcatcttacaaccatttgtggtcatgagagctggggtggggaaggattgtcacttgacccccccagctctgtttctaagtgctgaaagagctccaggctatgctacgggaggagaagccagctactgaggaaaagccagctactgagaaaaagcgggagtggtttaccattctcctcccccacctttcaccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggtgaggagcccaaggagaggcctccaggaacaggaggagctctgcttccatatgtggggaggaaagggtgggctctgccagagcagcctgtgaactaatgcccagcattcctcaaggtcagccagacaaaaaggaacttaggtcttgggcagaggaggtgtagcctggggcaaagtgatgagatgtccctcctttccttggcctgatccttgtctgccttcacttccctaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaaggtaggcttcaaagagcctatattcctctttttcccacaccgatcaagtcaactcagtactcacgggagaaaaatagactttatttacaagtaataacatttagaaaagatccatccccggcccttaaaaaccttcccatcactccaaatcccaccccagtgcaagtctggggaaggtagggtgtgagctgctgctgaaggctgtcccccaaccccactcctgagacatagggcccatccgtcctgggaaagagcatcctctggcaggtgctcccaccaggtcagacccagtcctggacttcaagagtgagggcccctgctgggcccagccaccaggacagcaggaaccagggcctactcctcttatggtcccttctagatccagaggctaagaggaagactggccaggcccaaggacccagccatcaaaaccagcctcaaatctggttgtgatggagaagtgactttgctttaagaaaaaaggaggcaaggtagggagagcgcccacactgtccatgctccaggccccctgggccagctccgagaaggcgccagtgaaggaccagggaccaggccagggtgcgggcaggcatcactgtctctaggggtttggctactgttggcctgggagctgagagaaggcactgagagggacagtaggcggaggaccaggtgaggtcagcatcggggacacaggtggggccactcactggtactggccctttagtgctttgcctgaaagagacacagtcacatggccagatgagaacttgcgatactagcctgcacccactggctgggaagatctcttcctgctcccacgcccctgtctggatcccctcccttgtgagccccagggttatcagttgctggctgtgcctgagcagctctgggtgctctccatgagaatggggccatctgtcttctctccttggagaggagctaccagg

SEQ ID NO: 143912 - DNA, 853 bp, Homo sapiens
  Payload ID: 8439
  Gene Symbol: IL18BP
  Gene Name: interleukin 18 binding protein
  ENST ID: ENST00000531053
  CDS Start-End: 154-753
gttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggtacgcagctgtgcaaggccttggtgctggagcagctgacccctgccctgcacagcaccaacttctcctgtgtgctcgtggaccctgaacaggttgtccagcgtcacgtcgtcctggcccagctctgggtgaggagcccaaggagaggcctccaggaacaggaggagctctgcttccatatgtggggaggaaagggtgggctctgccagagcagcctgtgaactaatgcccagcattcctcaaggtcagccagacaaaaaggaacttaggtcttgggcagaggaggtgtagcctggggcaaagtgatgagatgtccctcct

SEQ ID NO: 143913 - DNA, 1566 bp, Homo sapiens
  Payload ID: 8439
  Gene Symbol: IL18BP
  Gene Name: interleukin 18 binding protein
  Uniprot ID: O95998
  ENST ID: ENST00000620017
  CDS Start-End: 167-658
tttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcccccagtgttcccagcagctaagcagtgtccagcattggaagtgacctggccagaggtggaagtgccactgaatggaacgctgagcttatcctgtgtggcctgcagccgcttccccaacttcagcatcctctactggctgggcaatggttccttcattgagcacctcccaggccgactgtgggaggggagcaccagccgggaacgtgggagcacaggctgggctgagggcaaccttgccccccacccaagaagccctgccctccagccacagcagtccacagcagcagggttaagactcagcacagggccagcagcagcacaaccttgaccagagcttgggtcctacctgtctacctggagtgaacagtccctgactgcctgtaggctgcgtggatgcgcaacacaccccctccttctctgctttgggtcccttctctcaccaaattcaaactccattcccacctacctagaaaatcacagcctccttataatgcctcctcctcctgccattctctctccacctatccattagccttcctaacgtcctactcctcacactgctctactgctcagaaaccaccaagactgttgatgccttagccttgcactccagggccctacctgcatttcccacatgactttctggaagcctcccaactattcttgcttttcccagacagctcccactcccatgtctctgctcatttagtcccgtcttcctcaccgccccagcaggggaacgctcaagcctggttgaaatgctgcctcttcagtgaagtcatcctctttcagctctggccgcattctgcagacttcctatcttcgtgctgtatgttttttttttcccccttcactctaatggactgttccagggaagggatgggggcagcagctgcttcggatccacactgtatctgtgtcatccccacatgggtcctcataaaggattattcaatggaggcatcctgacatctgttcatttaggcttcagttccactcccaggaactttgcctgtcccacgagggagtatgggagagagggactgccacacagaagctgaagacaacacctgcttcaggggaacacaggcgcttgaaaaagaaaagagagaacagcccataatgctccccgggagcagaggccactaatggagagtgggaagagcctggaaagatgtggcctcaggaaaagggatgagagaaaggaggtggtatggaagactcagcaggaacaag

SEQ ID NO: 143914 - DNA, 3661 bp, Homo sapiens
  Payload ID: 8440
  Gene Symbol: IL18R1
  Gene Name: interleukin 18 receptor 1
  Uniprot ID: Q13478
  ENST ID: ENST00000233957
  CDS Start-End: 147-1772
tcaggaggcggagatcgctgcttctcacctactttctgaacttggcctccgcagtcgcgacctggcgtgaaggaggagctgccgcccccgccccagcctcggggacgcctctctgaagagaagccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttaccccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaatacattaatgaaccatt

SEQ ID NO: 143915 - DNA, 537 bp, Homo sapiens
  Payload ID: 8440
  Gene Symbol: IL18R1
  Gene Name: interleukin 18 receptor 1
  ENST ID: ENST00000334376
  CDS Start-End: 25-537
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagataggaccacctatttgcaggaaaacaagctcagggctccactga

SEQ ID NO: 143916 - DNA, 1749 bp, Homo sapiens
  Payload ID: 8440
  Gene Symbol: IL18R1
  Gene Name: interleukin 18 receptor 1
  Uniprot ID: Q13478
  ENST ID: ENST00000410040
  CDS Start-End: 124-1749
aaagctataaagctgtaagagaaattggctttctgagttgtgaaactgtgggcagaaagttgaggaagaaagaactcaagtacaacccaatgaggagaagccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaa

SEQ ID NO: 143917 - DNA, 3854 bp, Homo sapiens
  Payload ID: 8440
  Gene Symbol: IL18R1
  Gene Name: interleukin 18 receptor 1
  Uniprot ID: Q13478
  ENST ID: ENST00000409599
  CDS Start-End: 357-1982
acgcggggcgtctgggtggaggagccggtcctggagcacggctgcgaggagcacccggaccggagggtccccagaccgggacctccgagtcagggaggattctacgccagggagcgccccagactgagagcgccccagaccgctacactcccggacccggagcttcgcccgaccgcgggcagtgcccacctgcagcctccaccggccgggtcaggaggcggagatcgctgcttctcacctactttctgaacttggcctccgcagtcgcgacctggcgtgaaggaggagctgccgcccccgccccagcctcggggacgcctctctgaagagaagccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttaccccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaa

SEQ ID NO: 143918 - DNA, 2773 bp, Homo sapiens
  Payload ID: 8441
  Gene Symbol: IL18RAP
  Gene Name: interleukin 18 receptor accessory protein
  Uniprot ID: O95256
  ENST ID: ENST00000264260
  CDS Start-End: 590-2389
acaatgtccatggtcatttacaaaataaggttttcctttttcctccagttataatcctttatttttgagctggtgtaacgtggctattgtgtcttctccaggtatctctctggataggaagaaatatagtagaaccctttgaaaatggatattttcacatattttcgttcagatacaaaagctggcagttactgaaataaggacttgaagttccttcctcttttttttatgtcttaagagcaggaaataaagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggttgttccacaaaaaaactcctttggacatattctacaaggagtgaagaggaatttgtcttattttgtgatttaccagagccacagaaatcacatttctgccacagaaatcgactctcaccaaaacaagtccctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattgtgggagacactaaactcaaaccagatattctggatcctgtcgaggacacactggaagtagaacttggaaagcctttaactattagctgcaaagcacgatttggctttgaaagggtctttaaccctgtcataaaatggtacatcaaagattctgacctagagtgggaagtctcagtacctgaggcgaaaagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggagtggtgctcctgtacatcctgcttggcaccatcgggaccctggtggccgtgctggcggcgagtgccctcctctacaggcactggattgaaatagtgctgctgtaccggacctaccagagcaaggatcagacgcttggggataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggagtgggattgagactgtggtttagagcctttgatttcctggactggactgacggcgagtgaattctctagaccttgggtactttcagtacacaacacccctaagatttcccagtggtccgagcagaatcagaaaatacagctacttctgccttatggctagggaactgtcatgtctaccatgtattgtacatatgactttatgtatacttgcaatcaaataaatattattttattagaaa

SEQ ID NO: 143919 - DNA, 1890 bp, Homo sapiens
  Payload ID: 8441
  Gene Symbol: IL18RAP
  Gene Name: interleukin 18 receptor accessory protein
  Uniprot ID: O95256
  ENST ID: ENST00000409369
  CDS Start-End: 314-1687
cgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattgtgggagacactaaactcaaaccagatattctggatcctgtcgaggacacactggaagtagaacttggaaagcctttaactattagctgcaaagcacgatttggctttgaaagggtctttaaccctgtcataaaatggtacatcaaagattctgacctagagtgggaagtctcagtacctgaggcgaaaagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggagtggtgctcctgtacatcctgcttggcaccatcgggaccctggtggccgtgctggcggcgagtgccctcctctacaggcactggattgaaatagtgctgctgtaccggacctaccagagcaaggatcagacgcttggggataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggagtgggattgagactgtggtttagagcctttgatttcctggactggactgacggcgagt

SEQ ID NO: 143920 - DNA, 587 bp, Homo sapiens
  Payload ID: 8441
  Gene Symbol: IL18RAP
  Gene Name: interleukin 18 receptor accessory protein
  ENST ID: ENST00000450855
  CDS Start-End: 454-587
tctctccctgggtctcagatccctgttgacactgctttctccagcactttcctctctctcccccgtttctcaccaaaaagttttgtgggtaaagtttagttcattatttctgccagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggttgttccacaaaaaaactcctttggacatattctacaaggagtgaagaggaatttgtcttatt

SEQ ID NO: 143921 - DNA, 1473 bp, Homo sapiens
  Payload ID: 8442
  Gene Symbol: IL19
  Gene Name: interleukin 19
  Uniprot ID: Q9UHD0
  ENST ID: ENST00000270218
  CDS Start-End: 940-1473
gctggagtgcaatggtgaaattatagcagactgcagtcttcaactcctgacctcaagcaattgtcctgcctcctcaacttcctgactacaggtgtgcatgaggactacaggcaggcatgtgccaacacatgcagctttttttttttttttttttcagagatgtggtctcgctttgttgcctacactggtctcaaactcttggcctcaagggatcctcccacctcggcttcccaaagtgcagagattacagtctcattttctctctctctgcattaatcaagaatgagagaaccctccaggggacaagatgaaggggaaatagatgatgtgcaaagaaatccttgctttatgaggggaaaaagtgttcctcatgaagttcaacaaaatgatgcaggtaaagcagttagctagcacctggcacatggcagacactcatagctgcctaaggcattggagaactggatcgtgctgcagccagaggcacctgcagagcctcatgggctggctgctgcagggtgtggctgattgagagtgcttttgtgagttggcctgcagggtacacttggtaacgtgccacagctctcaggaaagtgacctaagttggatttttctgcatggacatagaattgcaaaaaattctcatttgcatggagatggggagtttatttttcctagaagctgcatgtcaagacccagaagaaagaggcatttcataataatgattaatcagctatatcttaaagaagaaagaaaacaattaaggaaatacaatactaagaaaacaaggggaaaaaacaatctccccaaggtggatccacccagcaaaccttgacagcatttcctcttatccacctgaataaaaatgaccagccctttccaaatggcagagagcactgagaggagacacaaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttga

SEQ ID NO: 143922 - DNA, 1032 bp, Homo sapiens
  Payload ID: 8442
  Gene Symbol: IL19
  Gene Name: interleukin 19
  Uniprot ID: Q9UHD0
  ENST ID: ENST00000340758
  CDS Start-End: 26-673
tgcacacactgacaggagtccaagaatgtgcactgagggagcgtttccgcacagatctgcgtgttccttaccactcacacatgtgcacacacatatccatgtgtgtgtgccagtgctttggggctctgttccacggggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatgaa

SEQ ID NO: 143923 - DNA, 1586 bp, Homo sapiens
  Payload ID: 8442
  Gene Symbol: IL19
  Gene Name: interleukin 19
  Uniprot ID: Q9UHD0
  ENST ID: ENST00000620365
  CDS Start-End: 696-1229
ttccagtctcattttctctctctctgcattaatcaagaatgagagaaccctccaggggacaagatgaaggggaaatagatgatgtgcaaagaaatccttgctttatgaggggaaaaagtgttcctcatgaagttcaacaaaatgatgcaggtaaagcagttagctagcacctggcacatggcagacactcatagctgcctaaggcattggagaactggatcgtgctgcagccagaggcacctgcagagcctcatgggctggctgctgcagggtgtggctgattgagagtgcttttgtgagttggcctgcagggtacacttggtaacgtgccacagctctcaggaaagtgacctaagttggatttttctgcatggacatagaattgcaaaaaattctcatttgcatggagatggggagtttatttttcctagaagctgcatgtcaagacccagaagaaagaggcatttcataataatgattaatcagctatatcttaaagaagaaagaaaacaattaaggaaatacaatactaagaaaacaaggggaaaaaacaatctccccaaggtggatccacccagcaaaccttgacagcatttcctcttatccacctgaataaaaatgaccagccctttccaaatggcagagagcactgagaggagacacaaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatg

SEQ ID NO: 143924 - DNA, 1029 bp, Homo sapiens
  Payload ID: 8443
  Gene Symbol: IL2
  Gene Name: interleukin 2
  Uniprot ID: P60568
  ENST ID: ENST00000226730
  CDS Start-End: 286-747
ctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataaatataaa

SEQ ID NO: 143925 - DNA, 1006 bp, Homo sapiens
  Payload ID: 8444
  Gene Symbol: IL2RA
  Gene Name: interleukin 2 receptor, alpha
  ENST ID: ENST00000256876
  CDS Start-End: 140-931
aagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatc

SEQ ID NO: 143926 - DNA, 1562 bp, Homo sapiens
  Payload ID: 8444
  Gene Symbol: IL2RA
  Gene Name: interleukin 2 receptor, alpha
  ENST ID: ENST00000379954
  CDS Start-End: 159-761
agagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctt

SEQ ID NO: 143927 - DNA, 3176 bp, Homo sapiens
  Payload ID: 8444
  Gene Symbol: IL2RA
  Gene Name: interleukin 2 receptor, alpha
  Uniprot ID: P01589
  ENST ID: ENST00000379959
  CDS Start-End: 175-993
aactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaaaaa

SEQ ID NO: 143928 - DNA, 326 bp, Homo sapiens
  Payload ID: 8444
  Gene Symbol: IL2RA
  Gene Name: interleukin 2 receptor, alpha
  ENST ID: ENST00000447847
  CDS Start-End: 1-326
agatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccagattttcaaatacagacagaaatggctgcaaccatggagacgtccata

SEQ ID NO: 143929 - DNA, 4113 bp, Homo sapiens
  Payload ID: 8445
  Gene Symbol: IL2RB
  Gene Name: interleukin 2 receptor, beta
  Uniprot ID: P14784
  ENST ID: ENST00000216223
  CDS Start-End: 200-1855
aggccttgcccctctatcctctgcacaggaagtgggctggctctgggcttttagtctttgcggccccagcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaa

SEQ ID NO: 143930 - DNA, 499 bp, Homo sapiens
  Payload ID: 8445
  Gene Symbol: IL2RB
  Gene Name: interleukin 2 receptor, beta
  ENST ID: ENST00000440958
  CDS Start-End: 1-318
acatgcttctacaactcgagagccaacatctcctgtgtctggagccaagatggggctctgcaggacacttcctgccaagtccatgcctggccggacagacgatcactccagctgccgtgggaccaggctgggatgagggagcaggacaaggtgcccatgagggaggaatgccatggagccagtgggggaggcagtgcccctcacagtggttggcacaggggccccagcctggccttgctgcctggtgccatcctggcagcagagagatctgagaagagtcccttgggccagctgtgtgggtccttcctgttcttctaaagagggtcttttgccatgaaaggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccat

SEQ ID NO: 143931 - DNA, 587 bp, Homo sapiens
  Payload ID: 8445
  Gene Symbol: IL2RB
  Gene Name: interleukin 2 receptor, beta
  ENST ID: ENST00000445595
  CDS Start-End: 322-587
acttcgctctcctgccagcatgtgaaggtgccttgcttccccttcgccttccaccacgattgtaagtttcctgaggcctccccagccatgtggaaccgacccgcaaatcaggcttggagaagcttggagaagcttggagaggcttggagaattgctgcatcctggacacgatgttccgacaccaccctcgccagcctccaggtcttggagttgaggcttctgattggggaagcctaatcacacgcacacacttcaggactgaggtctggagctgaggcttctgattggggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgat

SEQ ID NO: 143932 - DNA, 569 bp, Homo sapiens
  Payload ID: 8445
  Gene Symbol: IL2RB
  Gene Name: interleukin 2 receptor, beta
  ENST ID: ENST00000429622
  CDS Start-End: 131-569
acttcgctctcctgccagcatgtgaaggtgccttgcttccccttcgccttccaccacgattgtaagtttcctgaggcctccccagccatgtggaaccggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccaca

SEQ ID NO: 143933 - DNA, 660 bp, Homo sapiens
  Payload ID: 8445
  Gene Symbol: IL2RB
  Gene Name: interleukin 2 receptor, beta
  ENST ID: ENST00000453962
  CDS Start-End: 95-660
acttcgctctcctgccagcatgtgaaggtgccttgcttccccttcgccttccaccacgattggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaa

SEQ ID NO: 143934 - DNA, 1432 bp, Homo sapiens
  Payload ID: 8446
  Gene Symbol: IL2RG
  Gene Name: interleukin 2 receptor, gamma
  ENST ID: ENST00000374188
  CDS Start-End: 809-1105
agaggaaacgtgtgggtggggaggggtagtgggtgagggacccaggttcctgacacagacagactacacccagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaaggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatc

SEQ ID NO: 143935 - DNA, 1534 bp, Homo sapiens
  Payload ID: 8446
  Gene Symbol: IL2RG
  Gene Name: interleukin 2 receptor, gamma
  Uniprot ID: P31785
  ENST ID: ENST00000374202
  CDS Start-End: 93-1202
agaggaaacgtgtgggtggggaggggtagtgggtgagggacccaggttcctgacacagacagactacacccagggaatgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcaaaaa

SEQ ID NO: 143936 - DNA, 540 bp, Homo sapiens
  Payload ID: 8446
  Gene Symbol: IL2RG
  Gene Name: interleukin 2 receptor, gamma
  Uniprot ID: P31785
  ENST ID: ENST00000456850
  CDS Start-End: 1-540
atgggaatgaagacaccacagctggaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctga

SEQ ID NO: 143937 - DNA, 446 bp, Homo sapiens
  Payload ID: 8446
  Gene Symbol: IL2RG
  Gene Name: interleukin 2 receptor, gamma
  ENST ID: ENST00000482750
  CDS Start-End: 1-196
ctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaaggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaa

SEQ ID NO: 143938 - DNA, 404 bp, Homo sapiens
  Payload ID: 8446
  Gene Symbol: IL2RG
  Gene Name: interleukin 2 receptor, gamma
  ENST ID: ENST00000473378
  CDS Start-End: 107-404
tgaagagcaagcgccatgttgaagccatcattaccattcacatccctcttattcctgcagctgcccctgctgggagtggggctgaacacgacaattctgacgcccaatgggaatgaagacaccacagctggtgggaaatctgggactggagggggctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaagg

SEQ ID NO: 143939 - DNA, 959 bp, Homo sapiens
  Payload ID: 8446
  Gene Symbol: IL2RG
  Gene Name: interleukin 2 receptor, gamma
  ENST ID: ENST00000487883
  CDS Start-End: 432-959
agggaatgaagagcaagcgccatgttgaagccatcattaccattcacatccctcttattcctgcagctgcccctgctgggagtggggctgaacacgacaattctgacgcccaatgggaatgaagacaccacagctggtgggaaatctgggactggagggggctggtgagaagggtggctgtgggaaggggccgtacagagatctggtgcctgccactggccattacaatcatgtgggcagaattgaaaagtggagtgggaagggcaagggggagggttccctgcctcacgctacttcttctttctttcttgtttgtttgtttctttctttcttttgaggcagggtctcactatgttgcctaggctggtctcaaactcctggcctctagtgatcctcctgcctcagcctttcaaagcaccaggattacagacatgagccaccgtgcttggcctcctccttctgaccatcatttctctttccctccctgccttcattttctccccaatctagatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcag

SEQ ID NO: 143940 - DNA, 783 bp, Homo sapiens
  Payload ID: 8446
  Gene Symbol: IL2RG
  Gene Name: interleukin 2 receptor, gamma
  ENST ID: ENST00000464642
  CDS Start-End: 125-783
agtctcaacagggacccagctcaggcagcagctaaggctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggt

SEQ ID NO: 143941 - DNA, 925 bp, Homo sapiens
  Payload ID: 8447
  Gene Symbol: IL20
  Gene Name: interleukin 20
  Uniprot ID: Q9NYY1
  ENST ID: ENST00000367096
  CDS Start-End: 45-575
ctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagca

SEQ ID NO: 143942 - DNA, 1553 bp, Homo sapiens
  Payload ID: 8447
  Gene Symbol: IL20
  Gene Name: interleukin 20
  Uniprot ID: Q9NYY1
  ENST ID: ENST00000367098
  CDS Start-End: 364-894
gatggcgcagccacagcttctgtgagattcgatttctccccagttcccctgtgggtctgaggggaccagaagggtgagctacgttggctttctggaaggggaggctatatgcgtcaattccccaaaacaagttttgacatttcccctgaaatgtcattctctatctattcactgcaagtgcctgctgttccaggccttacctgctgggcactaacggcggagccaggatggggacagaataaaggagccacgacctgtgccaccaactcgcactcagactctgaactcagacctgaaatcttctcttcacgggaggcttggcagtttttcttactcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgcataaca

SEQ ID NO: 143943 - DNA, 1153 bp, Homo sapiens
  Payload ID: 8447
  Gene Symbol: IL20
  Gene Name: interleukin 20
  Uniprot ID: Q9NYY1
  ENST ID: ENST00000391930
  CDS Start-End: 45-500
ctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgc

SEQ ID NO: 143944 - DNA, 2047 bp, Homo sapiens
  Payload ID: 8448
  Gene Symbol: IL20RB
  Gene Name: interleukin 20 receptor beta
  Uniprot ID: Q6UXL0
  ENST ID: ENST00000329582
  CDS Start-End: 250-1185
aaagttacattttctctggaactctcctaggccactccctgctgatgcaacatctgggtttgggcagaaaggagggtgcttcggagcccgccctttctgagcttcctgggccggctctagaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtctttaaa

SEQ ID NO: 143945 - DNA, 956 bp, Homo sapiens
  Payload ID: 8448
  Gene Symbol: IL20RB
  Gene Name: interleukin 20 receptor beta
  ENST ID: ENST00000491483
  CDS Start-End: 29-196
gctttgtttacctaagcaatcctgggcaatggcgggcgccccttccccagcctcgttgccgccttgcagtttgatctcagactgctgtgctagcaatcagcgcgattccgtgggcgtaggaccctctgagccaggctggagtgcagtggtgcaatctcagcttactgcaacctccgccagtgaggcccttcattagacactaatttgaagctatggcattcccccactatgagcccacctgtcagccaggctatctgccttgatcctagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggcc

SEQ ID NO: 143946 - DNA, 1887 bp, Homo sapiens
  Payload ID: 8448
  Gene Symbol: IL20RB
  Gene Name: interleukin 20 receptor beta
  ENST ID: ENST00000469964
  CDS Start-End: 106-255
cagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacaggctggagtgcagtggtgcaatctcagcttactgcaacctccgccagtgaggcccttcattagacactaatttgaagctatggcattcccccactatgagcccacctgtcagccaggctatctgccttgatcctagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtctttaaa

SEQ ID NO: 143947 - DNA, 1787 bp, Homo sapiens
  Payload ID: 8448
  Gene Symbol: IL20RB
  Gene Name: interleukin 20 receptor beta
  ENST ID: ENST00000475972
  CDS Start-End: 1-363
gccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaagaactgcctttcttctgagtgtccacttgtgtccggaattggtgggttcttgatctcactgacttcaagaatgaagccgcagaccctcgcgccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtc

SEQ ID NO: 143948 - DNA, 3485 bp, Homo sapiens
  Payload ID: 8449
  Gene Symbol: IL20RA
  Gene Name: interleukin 20 receptor, alpha
  Uniprot ID: Q9UHF4
  ENST ID: ENST00000316649
  CDS Start-End: 237-1898
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccgtatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcgcatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 143949 - DNA, 1244 bp, Homo sapiens
  Payload ID: 8449
  Gene Symbol: IL20RA
  Gene Name: interleukin 20 receptor, alpha
  ENST ID: ENST00000367746
  CDS Start-End: 237-866
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacggtaagcctgaaatggaatggggcatacattcatgtaccactctgtagctaatgtgggaacaaacaaccctgatgcattgattctctgcatgtgaatctgggaagtcatgatgttcaaaagatacgccgcacaaaataaagttctatatacagaaattttacagaactaacttcagatcttctttacagaaactctgttgacaggatatggtgttgttattggagtgtagagagattgtacacttcactttgatgaagagctttcacttgcacagtctttctctgagaagaagaaaaaaatgtgagcaaggacccaggacaatgaataagaactctatccatgtgttgtttagaattgttctcagcattggtccagttcctgaccatgctctgctgagctaaaggaaaagagtatattgaaactgttgct

SEQ ID NO: 143950 - DNA, 3522 bp, Homo sapiens
  Payload ID: 8449
  Gene Symbol: IL20RA
  Gene Name: interleukin 20 receptor, alpha
  Uniprot ID: Q9UHF4
  ENST ID: ENST00000367748
  CDS Start-End: 607-1935
ccgatattgaactttaactgaccatcagaccggcctgaataccagaatctctttgcaatgcactcgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatcacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccgtatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcgcatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 143951 - DNA, 3382 bp, Homo sapiens
  Payload ID: 8449
  Gene Symbol: IL20RA
  Gene Name: interleukin 20 receptor, alpha
  Uniprot ID: Q9UHF4
  ENST ID: ENST00000541547
  CDS Start-End: 281-1795
ggtcggggacggttaccatgcggggcccctcgccggccagtcccaggttcccgccaccaccgccgcggccgcgcggaggggcccctgtggatgccgcgtctcggccgccgggccccgcagtcctgcaagccgcgcgtcgcgagatccgcgctttaaaagccaaactccccgaaagggtcagccccgaaggaacatgatccagaaagacgcagcttcttaaattccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccgtatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctctcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcgcatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatcacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 143952 - DNA, 655 bp, Homo sapiens
  Payload ID: 8449
  Gene Symbol: IL20RA
  Gene Name: interleukin 20 receptor, alpha
  ENST ID: ENST00000460306
  CDS Start-End: 237-365
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagggtattcccgtcctctcctgggtctttgggctaaggtctaaggactgctgggaagaccaccttagaagatgtatgtagttacctggatactacctgctcgtaattgaaggattatctacaatgtcttctgtacaacgtgggcttactaaggttctatgactttgccactctcagaattccttttgatgtagaaactcagagttgacaggaccttaaaagtcaccccacccagctgccactctcttgattgtcctctgcagcatcacttccaagtaatgacctgtctgctgtgtgagcacctctcatcacaggatactcactaccctgcacc

SEQ ID NO: 143953 - DNA, 921 bp, Homo sapiens
  Payload ID: 8449
  Gene Symbol: IL20RA
  Gene Name: interleukin 20 receptor, alpha
  ENST ID: ENST00000468393
  CDS Start-End: 391-921
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatcacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccgtatctattaccgtgtttcttttttctgtgatgggctattccatctaccgatatatccacgttggcaaagagaaacacccagcaaatttg

SEQ ID NO: 143954 - DNA, 521 bp, Homo sapiens
  Payload ID: 8449
  Gene Symbol: IL20RA
  Gene Name: interleukin 20 receptor, alpha
  ENST ID: ENST00000635289
  CDS Start-End: 254-521
ggccagtcccaggttcccgccaccaccgccgcggccgcgcggaggggcccctgtggatgccgcgtctcggccgccgggccccgcagtcctgcaagccgcgcgtcgcgagatccgcgctttaaaagccaaactccccgaaagggtcagccccgaaggaacatgatccagaaagacgcagcttcttaaattccctgtgtctctggtggtttgcctaaacctgcaaacatcaccttcttatccatcaacatgaagaatgtcctacaatggactccaccagagggtcttcaaggagttaaagttacttacactgtgcagtatttcatctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcc

SEQ ID NO: 143955 - DNA, 629 bp, Homo sapiens
  Payload ID: 8450
  Gene Symbol: IL21
  Gene Name: interleukin 21
  Uniprot ID: Q9HBE4
  ENST ID: ENST00000264497
  CDS Start-End: 59-547
gttctcagtcaagctgaagtgaaaacgagaccaaggtctagctctactgttggtacttatgagatccagtcctggcaacatggagaggattgtcatctgtctgatggtcatcttcttggggacactggtccacaaatcaagctcccaaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgctttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaagatgattcatcagcatctgtcctctagaacacacggaagtgaagattcctgaggatctaacttgcagttggacactatgttacatactctaatatagtagtgaaagtcatttctttgtattccaagtggaggag

SEQ ID NO: 143956 - DNA, 707 bp, Homo sapiens
  Payload ID: 8450
  Gene Symbol: IL21
  Gene Name: interleukin 21
  Uniprot ID: Q9HBE4
  ENST ID: ENST00000611104
  CDS Start-End: 47-508
gctgaagtgaaaacgagaccaaggtctagctctactgttggtacttatgagatccagtcctggcaacatggagaggattgtcatctgtctgatggtcatcttcttggggacactggtccacaaatcaagctcccaaggtcaagatcgccacatgattagaatgcgtcaacttatagatattgttgatcagctgaaaaattatgtgaatgacttggtccctgaatttctgccagctccagaagatgtagagacaaactgtgagtggtcagctttttcctgctttcagaaggcccaactaaagtcagcaaatacaggaaacaatgaaaggataatcaatgtatcaattaaaaagctgaagaggaaaccaccttccacaaatgcagggagaagacagaaacacagactaacatgcccttcatgtgattcttatgagaaaaaaccacccaaagaattcctagaaagattcaaatcacttctccaaaaggtatctaccttaagtttcatttgattttctgctttatctttacctatccagatttgcttcttagttactcacggtatactatttccacagatgattcatcagcatctgtcctctagaacacacggaagtgaagattcctgaggatctaacttgcagttggacactatgttacatactctaatatagtagtgaaagtcatttctttgtattccaagtggaggag

SEQ ID NO: 143957 - DNA, 4849 bp, Homo sapiens
  Payload ID: 8451
  Gene Symbol: IL21R
  Gene Name: interleukin 21 receptor
  Uniprot ID: Q9HBE5
  ENST ID: ENST00000337929
  CDS Start-End: 474-2090
ctcttcctccccactctgcacatgcggctgggtggcagccagcggcctcagacagacccactggcgtctctctgctgagtgaccgtaagctcggcgtctggccctctgcctgcctctccctgagtgtggctgacagccacgcagctgtgtctgtctgtctgcggcccgtgcatccctgctgcggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggcaggaggctggaaggttctagaacactgatggttataagagtgggactgtgagcctgggatcggggggtgtgagacttggatgggagcacaagagtggaaacacagcttctgcacggagcaggcgcagccctcaacaccccgtgcacctgcaccctagggactcttgggtccagatgtgctgtggttttcacaccttcttgggggcaacaggttccaggagccacctgtgggtgccacctgagccacaggctcccaggaaagcagcacagctctcctgcacccagagcttgctgggtggcggaggggaacacagatggttggggaaggcctgaggccagattgggggactctggactggggcagatgaggctcctcagaatcccacctttgaagggaactcagcttataaacacagaggagcaaagttggagggccgggcgtagtggctcacacctgtgatctcagcactttgggaggccaaggaaggtggatcacttgaggccaggagttcgagaccagcctgggcaacatagcaaggccccatctctacaaaaattattattttttaaaaaaattagccaggtgtggtggtgcttgcctatagtcccagctactcgggaggctaaggtgggaggatcgctggagcccaggaatttgaggctgcagtgagctgtgattacaccgttgcactccagcctgggtcacagatcaagaccctgtctcttaaaaataaaagttggagacaagagctggctcacctgaaaggagggattagtaggtaggagggtggatggaggatggatggatgtgtgggtggataggaagatggtattaagttggtgcaaaagtctttgatattactcttaatggctttaataaaaagcttgaaggaagaatgattggttggatagacagagataaatgcatactggaaacaaagataaagataaaacacaagttataccaggccagcaactctattttgttcactgcctttagtcccagcctggcacatagtaggcactcaataaagcctgatttgtagca

SEQ ID NO: 143958 - DNA, 2953 bp, Homo sapiens
  Payload ID: 8451
  Gene Symbol: IL21R
  Gene Name: interleukin 21 receptor
  Uniprot ID: Q9HBE5
  ENST ID: ENST00000395754
  CDS Start-End: 135-1751
cctcaggcaaaccactagaggcagctcagatagaggagctctttgggaagagacgccgggcaggcagaagcagcaggtaccccctccacatccctagggctctgtgatgtaggcagaggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattga

SEQ ID NO: 143959 - DNA, 3009 bp, Homo sapiens
  Payload ID: 8451
  Gene Symbol: IL21R
  Gene Name: interleukin 21 receptor
  Uniprot ID: Q9HBE5
  ENST ID: ENST00000564089
  CDS Start-End: 603-2219
actctgcacatgcggctgggtggcagccagcggcctcagacagacccactggcgtctctctgctgagtgaccgtaagctcggcgtctggccctctgcctgcctctccctgagtgtggctgacagccacgcagctgtgtctgtctgtctgcggcccgtgcatccctgctgcggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaagatgaggcaatgaggctgcgagaggtagagtgattttccctcggtgactcaactgggacgtagcaggtcgggcagtcaagccaggtgaccccatgagctgtcgctgcatctttctcatgaagcacggggaacgggtcggatggcccgtgggagtcagcatgccgcgtggctgggccgcccccttgctcctgctgctgctccagggaggctggggctgccccgacctcgtctgctacaccgattacctccagacggtcatctgcatcctggaaatgtggaacctccaccccagcacgctcacccttacctggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcatcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtgagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagaggagttaaaggaaggctggaaccctcacctgctgcttctcctcctgcttgtcatagtcttcattcctgccttctggagcctgaagacccatccattgtggaggctatggaagaagatatgggccgtccccagccctgagcggttcttcatgcccctgtacaagggctgcagcggagacttcaagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttc

SEQ ID NO: 143960 - DNA, 1150 bp, Homo sapiens
  Payload ID: 8452
  Gene Symbol: IL22
  Gene Name: interleukin 22
  Uniprot ID: Q9GZX6
  ENST ID: ENST00000328087
  CDS Start-End: 57-596
cttcgaccaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcc

SEQ ID NO: 143961 - DNA, 1168 bp, Homo sapiens
  Payload ID: 8452
  Gene Symbol: IL22
  Gene Name: interleukin 22
  Uniprot ID: Q9GZX6
  ENST ID: ENST00000538666
  CDS Start-End: 72-611
gtcacaagcagaatcttcagaacaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcctaa

SEQ ID NO: 143962 - DNA, 2798 bp, Homo sapiens
  Payload ID: 8453
  Gene Symbol: IL22RA1
  Gene Name: interleukin 22 receptor, alpha 1
  Uniprot ID: Q8N6P7
  ENST ID: ENST00000270800
  CDS Start-End: 40-1764
gcagagtagaggccaagggagggctctgtgccagccccgatgaggacgctgctgaccatcttgactgtgggatccctggctgctcacgcccctgaggacccctcggatctgctccagcacgtgaaattccagtccagcaactttgaaaacatcctgacgtgggacagcgggccggagggcaccccagacacggtctacagcatcgagtataagacgtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagctctctgcagcacactaccctcaagccacctgatgtgacctgtatctccaaagtgagatcgattcagatgattgttcatcctacccccacgccaatccgtgcaggcgatggccaccggctaaccctggaagacatcttccatgacctgttctaccacttagagctccaggtcaaccgcacctaccaaatgcaccttggagggaagcagagagaatatgagttcttcggcctgacccctgacacagagttccttggcaccatcatgatttgcgttcccacctgggccaaggagagtgccccctacatgtgccgagtgaagacactgccagaccggacatggacctactccttctccggagccttcctgttctccatgggcttcctcgtcgcagtactctgctacctgagctacagatatgtcaccaagccgcctgcacctcccaactccctgaacgtccagcgagtcctgactttccagccgctgcgcttcatccaggagcacgtcctgatccctgtctttgacctcagcggccccagcagtctggcccagcctgtccagtactcccagatcagggtgtctggacccagggagcccgcaggagctccacagcggcatagcctgtccgagatcacctacttagggcagccagacatctccatcctccagccctccaacgtgccacctccccagatcctctccccactgtcctatgccccaaacgctgcccctgaggtcgggcccccatcctatgcacctcaggtgacccccgaagctcaattcccattctacgccccacaggccatctctaaggtccagccttcctcctatgcccctcaagccactccggacagctggcctccctcctatggggtatgcatggaaggttctggcaaagactcccccactgggacactttctagtcctaaacaccttaggcctaaaggtcagcttcagaaagagccaccagctggaagctgcatgttaggtggcctttctctgcaggaggtgacctccttggctatggaggaatcccaagaagcaaaatcattgcaccagcccctggggatttgcacagacagaacatctgacccaaatgtgctacacagtggggaggaagggacaccacagtacctaaagggccagctccccctcctctcctcagtccagatcgagggccaccccatgtccctccctttgcaacctccttcccgtccatgttccccctcggaccaaggtccaagtccctggggcctgctggagtcccttgtgtgtcccaaggatgaagccaagagcccagcccctgagacctcagacctggagcagcccacagaactggattctcttttcagaggcctggccctgactgtgcagtgggagtcctgaggggaatgggaaaggcttggtgcttcctccctgtccctacccagtgtcacatccttggctgtcaatcccatgcctgcccacgccacacactctgcgatctggcctcagacgggtgcccttgagagaagcagagggagtggcatgcagggcccctgccatgggtgcgctcctcaccggagcaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaacctgcacttctgccaaggccagggccagcaggacggcaggactctagggaggggtgtggcctgcagctcattcccagccagggcaactgcctgacgttgcacgatttcagcttcattcctctgatagaacaaagcgaaatgcaggtccaccagggagggagacacacaagccttttctgcaggcaggagtttcagaccctatcctgagaatggggtttgaaaggaaggtgagggctgtggcccctggacgggtacaataacacactgtactgatgtcacaactttgcaagctctgccttgggttcagcccatctgggctcaaattccagcctcaccactcacaagctgtgtgacttcaaacaaatgaaatcagtgcccagaacctcggtttcctcatctgtaatgtggggatcataacacctacctcatggagttgtggtgaagatgaaatgaagtcatgtctttaaagtgcttaatagtgcctggtacatgggcagtgcccaataaacggtagctattt

SEQ ID NO: 143963 - DNA, 2801 bp, Homo sapiens
  Payload ID: 8454
  Gene Symbol: IL22RA2
  Gene Name: interleukin 22 receptor, alpha 2
  Uniprot ID: Q969J5
  ENST ID: ENST00000349184
  CDS Start-End: 302-997
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctttttttgcttta

SEQ ID NO: 143964 - DNA, 2886 bp, Homo sapiens
  Payload ID: 8454
  Gene Symbol: IL22RA2
  Gene Name: interleukin 22 receptor, alpha 2
  Uniprot ID: Q969J5
  ENST ID: ENST00000296980
  CDS Start-End: 302-1093
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatcatgttctcatgcagcatgaaaagctctcaccagaagccaagtggatgctggcagcacatttcttgtaacttcccaggctgcagaacattggctaaatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctt

SEQ ID NO: 143965 - DNA, 2620 bp, Homo sapiens
  Payload ID: 8454
  Gene Symbol: IL22RA2
  Gene Name: interleukin 22 receptor, alpha 2
  Uniprot ID: Q969J5
  ENST ID: ENST00000339602
  CDS Start-End: 302-694
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaagagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctt

SEQ ID NO: 143966 - DNA, 2912 bp, Homo sapiens
  Payload ID: 8455
  Gene Symbol: IL23R
  Gene Name: interleukin 23 receptor
  Uniprot ID: Q5VWK5
  ENST ID: ENST00000347310
  CDS Start-End: 172-2061
gctgacatttccattgacctcagaagtgaaaatctaaagtgagtgctgacaggcaggcagtgaggaaagaagacatgacacagccaacaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctggaaaaaaaaaaaaaa

SEQ ID NO: 143967 - DNA, 1459 bp, Homo sapiens
  Payload ID: 8455
  Gene Symbol: IL23R
  Gene Name: interleukin 23 receptor
  Uniprot ID: Q5VWK5
  ENST ID: ENST00000395227
  CDS Start-End: 233-916
ttacccatccattttaggttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacaggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaat

SEQ ID NO: 143968 - DNA, 1295 bp, Homo sapiens
  Payload ID: 8455
  Gene Symbol: IL23R
  Gene Name: interleukin 23 receptor
  Uniprot ID: Q5VWK5
  ENST ID: ENST00000425614
  CDS Start-End: 51-1175
ctcattttctcttgccaccactaagtaagaagagccttttgcctcccaccatgattctgaggccttaccagccatgtggaactgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttca

SEQ ID NO: 143969 - DNA, 1507 bp, Homo sapiens
  Payload ID: 8455
  Gene Symbol: IL23R
  Gene Name: interleukin 23 receptor
  ENST ID: ENST00000473881
  CDS Start-End: 29-244
aagtaagaagagccttttgcctcccaccatgattctgaggccttaccagccatgtggaactgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacaggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaa

SEQ ID NO: 143970 - DNA, 1046 bp, Homo sapiens
  Payload ID: 8456
  Gene Symbol: IL23A
  Gene Name: interleukin 23, alpha subunit p19
  Uniprot ID: Q9NPF7
  ENST ID: ENST00000228534
  CDS Start-End: 171-740
gagaaaaacaacaggaagcagcttacaaactcggtgaacaactgagggaaccaaaccagagacgcgctgaacagagagaatcaggctcaaagcaagtggaagtgggcagagattccaccaggactggtgcaaggcgcagagccagccagatttgagaagaaggcaaaaagatgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggcta

SEQ ID NO: 143971 - DNA, 1701 bp, Homo sapiens
  Payload ID: 8457
  Gene Symbol: IL24
  Gene Name: interleukin 24
  Uniprot ID: Q13007
  ENST ID: ENST00000294984
  CDS Start-End: 275-895
cttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaa

SEQ ID NO: 143972 - DNA, 1819 bp, Homo sapiens
  Payload ID: 8457
  Gene Symbol: IL24
  Gene Name: interleukin 24
  Uniprot ID: Q13007
  ENST ID: ENST00000367093
  CDS Start-End: 275-739
cttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcgcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttcc

SEQ ID NO: 143973 - DNA, 1779 bp, Homo sapiens
  Payload ID: 8457
  Gene Symbol: IL24
  Gene Name: interleukin 24
  ENST ID: ENST00000367095
  CDS Start-End: 275-430
cttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttcc

SEQ ID NO: 143974 - DNA, 1320 bp, Homo sapiens
  Payload ID: 8457
  Gene Symbol: IL24
  Gene Name: interleukin 24
  Uniprot ID: Q13007
  ENST ID: ENST00000391929
  CDS Start-End: 276-899
gcttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtc

SEQ ID NO: 143975 - DNA, 182 bp, Homo sapiens
  Payload ID: 8457
  Gene Symbol: IL24
  Gene Name: interleukin 24
  ENST ID: ENST00000480741
  CDS Start-End: 1-182
atgaattttcaacagaggctgcaaagcctgtggactttagccagcaagctcaggataacatcacgagtgcccggctgctgcagcaggaggttctgcagaacgtctcgcaagaaaatgagatgttttccatcagagacagtgcacacaggcggtttctgctattccggagagcattcaaacag

SEQ ID NO: 143976 - DNA, 1621 bp, Homo sapiens
  Payload ID: 8457
  Gene Symbol: IL24
  Gene Name: interleukin 24
  Uniprot ID: Q13007
  ENST ID: ENST00000611909
  CDS Start-End: 276-467
gcttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagcaagctcaggataacatcacgagtgcccggctgctgcagcaggaggttctgcagaacgtctcgcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttcc

SEQ ID NO: 143977 - DNA, 1315 bp, Homo sapiens
  Payload ID: 8458
  Gene Symbol: IL25
  Gene Name: interleukin 25
  Uniprot ID: Q9H293
  ENST ID: ENST00000329715
  CDS Start-End: 259-792
ggcttgctgaaaataaaatcaggactcctaacctgctccagtcagcctgcttccacgaggcctgtcagtcagtgccccacttgtgactgagtgtgcagtgcccagcatgtaccaggtcagtgcagagggctgcctgagggctgtgctgagagggagaggagcagagatgctgctgagggtggagggaggccaagctgccaggtttggggctgggggccaagtggagtgagaaactgggatcccagggggagggtgcagatgagggagcgacccagattaggtgaggacagttctctcattagccttttcctacaggtggttgcattcttggcaatggtcatgggaacccacacctacagccactggcccagctgctgccccagcaaagggcaggacacctctgaggagctgctgaggtggagcactgtgcctgtgcctcccctagagcctgctaggcccaaccgccacccagagtcctgtagggccagtgaagatggacccctcaacagcagggccatctccccctggagatatgagttggacagagacttgaaccggctcccccaggacctgtaccacgcccgttgcctgtgcccgcactgcgtcagcctacagacaggctcccacatggacccccggggcaactcggagctgctctaccacaaccagactgtcttctaccggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtgaagtgctgtctggagcagcaggatcccgggacaggatggggggctttggggaaagcctgcacttctgcacattttgaaaagagcagctgctgcttagggccgccggaagctggtgtcctgtcattttctctcaggaaaggttttcaaagttctgcccatttctggaggccaccactcctgtctcttcctcttttcccatcccctgctaccctggcccagcacaggcactttctagatatttcccccttgctggagaagaaagagcccctggttttatttgtttgtttactcatcactcagtgagcatctactttgggtgcattctagtgtagttactagtcttttgacatggatgattctgaggaggaagctgttattgaatgtatagagatttatccaaataaatatctttatttaaaaatg

SEQ ID NO: 143978 - DNA, 744 bp, Homo sapiens
  Payload ID: 8458
  Gene Symbol: IL25
  Gene Name: interleukin 25
  Uniprot ID: Q9H293
  ENST ID: ENST00000397242
  CDS Start-End: 159-644
ctcaagtcactccctaaaaagacagtggaaataaatttgaataaacaaaacaggcttgctgaaaataaaatcaggactcctaacctgctccagtcagcctgcttccacgaggcctgtcagtcagtgccccacttgtgactgagtgtgcagtgcccagcatgtaccaggtggttgcattcttggcaatggtcatgggaacccacacctacagccactggcccagctgctgccccagcaaagggcaggacacctctgaggagctgctgaggtggagcactgtgcctgtgcctcccctagagcctgctaggcccaaccgccacccagagtcctgtagggccagtgaagatggacccctcaacagcagggccatctccccctggagatatgagttggacagagacttgaaccggctcccccaggacctgtaccacgcccgttgcctgtgcccgcactgcgtcagcctacagacaggctcccacatggacccccggggcaactcggagctgctctaccacaaccagactgtcttctaccggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtg

SEQ ID NO: 143979 - DNA, 1075 bp, Homo sapiens
  Payload ID: 8459
  Gene Symbol: IL26
  Gene Name: interleukin 26
  Uniprot ID: Q9NPH9
  ENST ID: ENST00000229134
  CDS Start-End: 66-581
atctaaccggcattagtatctcttgggctgctgtgagtgacacacgctgagtggggtgaagggaaatgctggtgaatttcattttgaggtgtgggttgctgttagtcactctgtctcttgccattgccaagcacaagcaatcttccttcaccaaaagttgttacccaaggggaacattgtcccaagctgttgacgctctctatatcaaagcagcatggctcaaagcaacgattccagaagaccgcataaaaaatatacgattattaaaaaagaaaacaaaaaagcagtttatgaaaaactgtcaatttcaagaacagcttctgtccttcttcatggaagacgtttttggtcaactgcaattgcaaggctgcaagaaaatacgctttgtggaggactttcatagccttaggcagaaattgagccactgtatttcctgtgcttcatcagctagagagatgaaatccattaccaggatgaaaagaatattttataggattggaaacaaaggaatctacaaagccatcagtgaactggatattcttctttcctggattaaaaaattattggaaagcagtcagtaaaccaaagccaagtacattgattttacagttattttgaaatacaataagaactgctagaaatatgtttataacagtctatttcttttaaaaactttttaacataatactgacggcatgttaggtgattcagaatagacaagaaggatttagtaaattaacgttttggatataagttgtcactaatttgcacattttctgtgttttcaaataatgtttccattctgaacatgttttgtcattcacaagtacattgtgtcaacttaatttaaagtatgtaacctgaattaactcgtgtaatatttgtgtgtggagtgggatgtggggggtggagggggaatgacagatttctggaatgcaatgtaatgttactgagacttaaatagatgttatgtatatgattgtctgtttaagtgtttgaaaattgttaattatgcccagtgtgaacttagtacttaacacattttgattttaattaaataaattgggtttccttc

SEQ ID NO: 143980 - DNA, 1044 bp, Homo sapiens
  Payload ID: 8460
  Gene Symbol: IL27
  Gene Name: interleukin 27
  Uniprot ID: Q8NEV9
  ENST ID: ENST00000356897
  CDS Start-End: 24-755
gaccaaagaggctgggccccgccatgggccagacggcaggcgaccttggctggcggctcagcctgttgctgcttcccttgctcctggttcaagctggtgtctggggattcccaaggcccccagggaggccccagctgagcctgcaggagctgcggagggagttcacagtcagcctgcatctcgccaggaagctgctctccgaggttcggggccaggcccaccgctttgcggaatctcacctgccaggagtgaacctgtacctcctgcccctgggagagcagctccctgatgtttccctgaccttccaggcctggcgccgcctctctgacccggagcgtctctgcttcatctccaccacgcttcagcccttccatgccctgctgggagggctggggacccagggccgctggaccaacatggagaggatgcagctgtgggccatgaggctggacctccgcgatctgcagcggcacctccgcttccaggtgctggctgcaggattcaacctcccggaggaggaggaggaggaagaggaggaggaggaggaggagaggaaggggctgctcccaggggcactgggcagcgccttacagggcccggcccaggtgtcctggccccagctcctctccacctaccgcctgctgcactccttggagctcgtcttatctcgggccgtgcgggagttgctgctgctgtccaaggctgggcactcagtctggcccttggggttcccaacattgagcccccagccctgatcggtggcttcttagccccctgccccccaccctttagaactttaggactggagtcttggcatcagggcagccttcgcatcatcagccttggacaagggagggctcttccagccccctgccccaggctctacccagtaactgaaagcccctctggtcctcgccagctatttatttcttggatatttatttattgtttagggagatgatggtttatttattgtcttggggcccgatggtcctcctcgggccaagcccccatgctgggtgcccaataaagcactctcatcca

SEQ ID NO: 143981 - DNA, 657 bp, Homo sapiens
  Payload ID: 8460
  Gene Symbol: IL27
  Gene Name: interleukin 27
  ENST ID: ENST00000568075
  CDS Start-End: 587-657
cccgcactggcccacgctgaagataggggacttgagttccagtcttccttctgctaccgaccggctttgtgaccttgaacaagacttcccctccctgattccatcctcatgtcacatctgaagcctccaacttctgtcactgagctcaggattcccaggcaagcccacggagtgccccacagggtcagagccgtaacaggacttggaaaataacccgaaaattgggctcagcctgttgctgcttcccttgctcctggttcaagctggtgtctggggattcccaaggcccccagggaggccccagctgagcctgcaggagctgcggagggagttcacagtcagcctgcatctcgccaggaagctgctctccgaggttcggggccaggcccaccgctttgcggaatctcacctgccaggagtgaacctgtacctcctgcccctgggagagcagctccctgatgtttccctgaccttccaggcctggcgccgcctctctgacccggagcgtctctgcttcatctccaccacgcttcagcccttccatgccctgctgggagggctggggacccagggccgctggaccaacatggagaggatgcagctgtgggccatgaggctggacctccgcgatctgcagcggcacctccgcttccaggt

SEQ ID NO: 143982 - DNA, 2962 bp, Homo sapiens
  Payload ID: 8461
  Gene Symbol: IL27RA
  Gene Name: interleukin 27 receptor, alpha
  Uniprot ID: Q6UWB1
  ENST ID: ENST00000263379
  CDS Start-End: 126-2036
ggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccagggaatttcactgtcggggtcccctatcgaatcactgtgaccgcagtctctgcttcaggcttggcctctgcatcctccgtctgggggttcagggaggaattagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatgtgagtggcaacacacagagtgtcaccctgcctgaccttccttggggtccctgtgagctgtgggtgacagcatctaccatcgctggacagggccctcctggtcccatcctccggcttcatctaccagataacaccctgaggtggaaagttctgccgggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagcaaaaaaaaaaaaaaaagaaaagaaaaaacactgcatttgggcaccatctcagctcccttgcatccaggtgcagcatggactgagttcttgacaacagaatgtggtcagaagtgacatatgccaacacggggtctgggtgggggctcccccacatcctttccttgcctatgagctggaacataacacatgcctatgatccagctttggtcatacccaaggggaaggtggagcaagaaatgaaaaggaacctgaatccctgaatgactgcatggatagaaccactaagaaaaataaacttttatatttttatagc

SEQ ID NO: 143983 - DNA, 1050 bp, Homo sapiens
  Payload ID: 8462
  Gene Symbol: IL3
  Gene Name: interleukin 3
  Uniprot ID: P08700
  ENST ID: ENST00000296870
  CDS Start-End: 179-637
gaggttccatgtcagataaagatccttccgacgcctgccccacaccaccacctccccccgccttgcccggggttgtgggcaccttgctgctgcacatataaggcgggaggctgttgccaactcttcagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggacttcaacaacctcaatggggaagaccaagacattctgatggaaaataaccttcgaaggccaaacctggaggcattcaacagggctgtcaagagtttacagaacgcatcagcaattgagagcattcttaaaaatctcctgccatgtctgcccctggccacggccgcacccacgcgacatccaatccatatcaaggacggtgactggaatgaattccggaggaaactgacgttctatctgaaaacccttgagaatgcgcaggctcaacagacgactttgagcctcgcgatcttttgagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaaca

SEQ ID NO: 143984 - DNA, 1706 bp, Homo sapiens
  Payload ID: 8463
  Gene Symbol: IL3RA
  Gene Name: interleukin 3 receptor, alpha (low affinity)
  Uniprot ID: P26951
  ENST ID: ENST00000331035
  CDS Start-End: 350-1486
gtcaggttcatggttacgaagctgctgaccccaggatcccagcccgtgggagagaagggggtctctgacagcccccacccctccccactgccagatccttattgggtctgagtttcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctgatcgccctgccctgtctcctgcaaacgaaggaagatccaaacccaccaatcacgaacctaaggatgaaagcaaaggctcagcagttgacctgggaccttaacagaaatgtgaccgatatcgagtgtgttaaagacgccgactattctatgccggcagtgaacaatagctattgccagtttggagcaatttccttatgtgaagtgaccaactacaccgtccgagtggccaacccaccattctccacgtggatcctcttccctgagaacagtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgatttttttttttttaa

SEQ ID NO: 143985 - DNA, 1476 bp, Homo sapiens
  Payload ID: 8463
  Gene Symbol: IL3RA
  Gene Name: interleukin 3 receptor, alpha (low affinity)
  Uniprot ID: P26951
  ENST ID: ENST00000381469
  CDS Start-End: 350-1252
gtcaggttcatggttacgaagctgctgaccccaggatcccagcccgtgggagagaagggggtctctgacagcccccacccctccccactgccagatccttattgggtctgagtttcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctgatcgccctgccctgtctcctgcaaacgaaggaaggtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgatttttttttttttaaccca

SEQ ID NO: 143986 - DNA, 662 bp, Homo sapiens
  Payload ID: 8463
  Gene Symbol: IL3RA
  Gene Name: interleukin 3 receptor, alpha (low affinity)
  ENST ID: ENST00000432757
  CDS Start-End: 170-662
cttcggggaaagctgctttcagcgcacacgggaagatatcagaaacatcctaggatcaggacaccccagatcttctcaactggaaccacgaaggctgtttcttccacacagtactttgatctccatttaagcaggcacctctgtcctgcgttccggagctgcgttcccgatggtcctcctttggctcacgctgctcctgatcgccctgccctgtctcctgcaaacgaaggaaggtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatac

SEQ ID NO: 143987 - DNA, 904 bp, Homo sapiens
  Payload ID: 8464
  Gene Symbol: IL31
  Gene Name: interleukin 31
  Uniprot ID: Q6EBC2
  ENST ID: ENST00000377035
  CDS Start-End: 28-522
ctgaagctggccttgctctctctcgccatggcctctcactcaggcccctcgacgtctgtgctctttctgttctgctgcctgggaggctggctggcctcccacacgttgcccgtccgtttactacgaccaagtgatgatgtacagaaaatagtcgaggaattacagtccctctcgaagatgcttttgaaagatgtggaggaagagaagggcgtgctcgtgtcccagaattacacgctgccgtgtctcagccctgacgcccagccgccaaacaacatccacagcccagccatccgggcatatctcaagacaatcagacagctagacaacaaatctgttattgatgagatcatagagcacctcgacaaactcatatttcaagatgcaccagaaacaaacatttctgtgccaacagacacccatgaatgtaaacgcttcatcctgactatttctcaacagttttcagagtgcatggacctcgcactaaaatcattgacctctggagcccaacaggccaccacttaaggccatctcttcctttcggattggcaggaacttaaggagccttaaaaagatgaccgacagctaagtgtgggaactctgccgtgattccttaagtacatttttccaatgaataatctcagggacccctcatatgggctagtcccgggagggctgagatgtgaatttgtgaattaccttgaaaaacattaggttattgttattagtcttggtatttatggaatgcttttcttctgcaggcttaagtcttacttattataccctcgtgagggtgggaggtggcagctatgttaatttattgatatttattgtactaagagttgtcaatgctccctgggggagccctcggaatctatttaataaattatattgaatttttctcata

SEQ ID NO: 143988 - DNA, 2695 bp, Homo sapiens
  Payload ID: 8465
  Gene Symbol: IL31RA
  Gene Name: interleukin 31 receptor A
  Uniprot ID: Q8NI17
  ENST ID: ENST00000297015
  CDS Start-End: 241-2478
ttaacaataatgcaatccatttcccagcataagtgggtaagtgccactttgacttgggctgggcttaaaagcacaagaaaagctcgcagacaatcagagtggaaacactcccacatcttagtgtggataaattaaagtccagattgttcttcctgtcctgacttgtgctgtgggaggtggagttgcctttgatgcaaatcctttgagccagcagaacatctgtggaacatcccctgatacatgaagctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggtatgtgacctgccccttcaggcctgattgtcccctggggaaaagttttgaggagctcccagtttcacctgagattccgcccagaaaatcccaatacctacgttcgaggatgccagaggggacccgcccagaagccaaagagcagcttctcttttctggtcaaagtttagtaccagatcatctgtgtgaggaaggagccccaaatccatatttgaaaaattcagtgacagccagggaatttcttgtgtctgaaaaacttccagagcacaccaagggagaagtctaaatgcgaccatagcatgagaccctcggggcctcagtgtggatggcccttgccagagaagatgtcaagactcggcacgcagcgcttgcttggccctgccacatcctgcctaggttaaagtttcccctgccccttgagctgccagttgaacttggtcggcaaagatgcgaccttgtactgggaagaagggatggtgataagcccgagttttgtaaaggaa

SEQ ID NO: 143989 - DNA, 2658 bp, Homo sapiens
  Payload ID: 8465
  Gene Symbol: IL31RA
  Gene Name: interleukin 31 receptor A
  Uniprot ID: Q8NI17
  ENST ID: ENST00000354961
  CDS Start-End: 249-2237
gtttttagttaacaataatgcaatccatttcccagcataagtgggtaagtgccactttgacttgggctgggcttaaaagcacaagaaaagctcgcagacaatcagagtggaaacactcccacatcttagtgtggataaattaaagtccagattgttcttcctgtcctgacttgtgctgtgggaggtggagttgcctttgatgcaaatcctttgagccagcagaacatctgtggaacatcccctgatacatgaagctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactcagcc

SEQ ID NO: 143990 - DNA, 2529 bp, Homo sapiens
  Payload ID: 8465
  Gene Symbol: IL31RA
  Gene Name: interleukin 31 receptor A
  Uniprot ID: Q8NI17
  ENST ID: ENST00000359040
  CDS Start-End: 66-2111
tgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactca

SEQ ID NO: 143991 - DNA, 2903 bp, Homo sapiens
  Payload ID: 8465
  Gene Symbol: IL31RA
  Gene Name: interleukin 31 receptor A
  Uniprot ID: Q8NI17
  ENST ID: ENST00000396834
  CDS Start-End: 497-2485
tgaaaagacatgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattagtttcactcttgtcgccaggttggagtacaatggcacgatcttggctcactgcaacctctgcctcccgggttcaagcgattctcctgcctcagcctcccgagtagctgggattacagttaacaataatgcaatccatttcccagcataagtgggtaagtgccactttgacttgggctgggcttaaaagcacaagaaaagctcgcagacaatcagagtggaaacactcccacatcttagtgtggataaattaaagtccagattgttcttcctgtcctgacttgtgctgtgggaggtggagttgcctttgatgcaaatcctttgagccagcagaacatctgtggaacatcccctgatacatgaagctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactca

SEQ ID NO: 143992 - DNA, 2426 bp, Homo sapiens
  Payload ID: 8465
  Gene Symbol: IL31RA
  Gene Name: interleukin 31 receptor A
  Uniprot ID: Q8NI17
  ENST ID: ENST00000396836
  CDS Start-End: 193-1941
caccagacagcactccagcactctgcttggggggcattcgaaacagcaaaatcactcataaaaggcaaaaaattgcaaaaaaaaatagtaataaccagcatggcactaaatagaccatgaaaagacatgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctgtaagcacgcccatagcgaagtggaaaaaaaccccaagccccagatagatgctatggatagacctgttgtaggcatggctcccccatctcattgtgacttgcaacctggcatgaatcacttagcttctttaaatctctctgaaaatggggccaagagcacccaccttttggggttttgggggttaaatgagagtgaagtgacagtacctgagaggagagtcctgaggaaatggaaggagttgttataatttgtcctggttaggccctgaattgacctcccgggagctccccgaccatcattcccaggaatggcgtgcctggcttaaagagtgaggaggaacagaccctgtcaccatgacttctactgcccctgccaaatcatgcttttgtttttcagtccaccttatctcctgacatcttaaatactgggcaaggcttggattcttgcttaggctaaataattttttcttatggtaaaatacacgtaaaatatttttccagtttaaacatttgaaagtgtacaatttagtggcattagaagcattcacaatattgtgcaaccatcaccactatttccagaactcttctatttctgcccaaatagaagccctatacccattcattagtcactccccattcctctcctcccacagcccctggcaactaccaaactgctttgtgtctctatggattgcctattttggatatttcatatacatagaatcataaaata

SEQ ID NO: 143993 - DNA, 2577 bp, Homo sapiens
  Payload ID: 8465
  Gene Symbol: IL31RA
  Gene Name: interleukin 31 receptor A
  Uniprot ID: Q8NI17
  ENST ID: ENST00000447346
  CDS Start-End: 66-2360
tgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggtatgtgacctgccccttcaggcctgattgtcccctggggaaaagttttgaggagctcccagtttcacctgagattccgcccagaaaatcccaatacctacgttcgaggatgccagaggggacccgcccagaagccaaagagcagcttctcttttctggtcaaagtttagtaccagatcatctgtgtgaggaaggagccccaaatccatatttgaaaaattcagtgacagccagggaatttcttgtgtctgaaaaacttccagagcacaccaagggagaagtctaaatgcgaccatagcatgagaccctcggggcctcagtgtggatggcccttgccagagaagatgtcaagactcggcacgcagcgcttgcttggccctgccacatcctgcctaggttaaagtttcccctgccccttgagctgccagttgaacttggtcggcaaagatgcgaccttgtactgggaagaagggatggtgataagcccgagttttgtaaaggaa

SEQ ID NO: 143994 - DNA, 2414 bp, Homo sapiens
  Payload ID: 8465
  Gene Symbol: IL31RA
  Gene Name: interleukin 31 receptor A
  Uniprot ID: Q8NI17
  ENST ID: ENST00000490985
  CDS Start-End: 546-2414
cagcagaacatctgtggaacatcccctgatacatgaagctctctccccagccttcatgtgttaacctggggatgatgtggacctgggcactgtggatgctcccctcactctgcaaattcagcctggcagttcctaacaggccatggacccgtaccttgcccagcggttgaggaatcctgctagactacagcctggcaacctcccccggacttgctgtacctggtgaaataggctaccagccagatgaccttggtgcatgggacccatccgcatctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaagataaattaaaacctttctggtgctataacatctctgtgtatccaatgttgcatgacaaagttggcgagccatattccatccaggcttatgccaaagaaggcgttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgtctttgagattatcctcataacttctctgattggtggaggccttcttattctcattatcctgacagtggcatatggtctcaaaaaacccaacaaattgactcatctgtgttggcccaccgttcccaaccctgctgaaagtagtatagccacatggcatggagatgatttcaaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggtatgtgacctgccccttcaggcctgattgtcccctggggaaaagttttgaggagctcccagtttcacctgagattccgcccagaaaatcccaatacctacgttcgaggatgccagaggggacccgcccagaagccaaagagcagcttctcttttctggtcaaagtttagtaccagatcatctgtgtgaggaaggagccccaaatccatatttgaaaaattcagtgacagccagggaatttcttgtgtctgaaaaacttccagagcacaccaagggagaagtctaa

SEQ ID NO: 143995 - DNA, 1171 bp, Homo sapiens
  Payload ID: 8465
  Gene Symbol: IL31RA
  Gene Name: interleukin 31 receptor A
  ENST ID: ENST00000611895
  CDS Start-End: 34-1008
ctctctccccagccttcatgtgttaacctggggatgatgtggacctgggcactgtggatgctcccctcactctgcaaattcagcctggcagctctgccagctaagcctgagaacatttcctgtgtctactactataggaaaaatttaacctgcacttggagtccaggaaaggaaaccagttatacccagtacacagttaagagaacttacgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacatagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctggatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaagctccatgtggcctggaactgtggagagtcctgaaaccagctgaggcggatggaagaaggccagtgcggttgttatggaagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatagaaactttacagatgctagtcccagacataaaagaaaataatgttctggatgtgcacgatggctcacgcctgtaatcccagcactttgaggccaagacgggtggatcgctgagttcaggagttcaagacaagtccaggcaacatagtgaaaccttgtttctaca

SEQ ID NO: 143996 - DNA, 1056 bp, Homo sapiens
  Payload ID: 8466
  Gene Symbol: IL32
  Gene Name: interleukin 32
  Uniprot ID: P24001
  ENST ID: ENST00000008180
  CDS Start-End: 86-592
gtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactgactcacagttccacatggctggggaagcctgaggaagcttacaatcatgggggaaggcggaagagaagcaaggcacgtcctacatggcagcaggagaagcagggtggggggaactaccaaacacttttgtccgcgtgtttgtgtgtttttttt

SEQ ID NO: 143997 - DNA, 1105 bp, Homo sapiens
  Payload ID: 8466
  Gene Symbol: IL32
  Gene Name: interleukin 32
  Uniprot ID: P24001
  ENST ID: ENST00000325568
  CDS Start-End: 227-793
gtactcagggagtttccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 143998 - DNA, 880 bp, Homo sapiens
  Payload ID: 8466
  Gene Symbol: IL32
  Gene Name: interleukin 32
  Uniprot ID: P24001
  ENST ID: ENST00000382213
  CDS Start-End: 29-568
gccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 143999 - DNA, 789 bp, Homo sapiens
  Payload ID: 8466
  Gene Symbol: IL32
  Gene Name: interleukin 32
  Uniprot ID: P24001
  ENST ID: ENST00000396887
  CDS Start-End: 202-597
ctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagatacc

SEQ ID NO: 144000 - DNA, 1067 bp, Homo sapiens
  Payload ID: 8466
  Gene Symbol: IL32
  Gene Name: interleukin 32
  Uniprot ID: P24001
  ENST ID: ENST00000396890
  CDS Start-End: 78-782
aagactgcgtgcagaaggtgactgtctcagtggagctgggtcatctcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtg

SEQ ID NO: 144001 - DNA, 920 bp, Homo sapiens
  Payload ID: 8466
  Gene Symbol: IL32
  Gene Name: interleukin 32
  Uniprot ID: P24001
  ENST ID: ENST00000440815
  CDS Start-End: 158-724
ggtggggtggggaaagcagcccattcctgggctcagagactcccaccccagctcagagggagcaggggcccagccagggacggaccctcattcctcccagggaccccagacctctgtctctctcggcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 144002 - DNA, 892 bp, Homo sapiens
  Payload ID: 8466
  Gene Symbol: IL32
  Gene Name: interleukin 32
  Uniprot ID: P24001
  ENST ID: ENST00000444393
  CDS Start-End: 130-696
cataaaaccagctgagtatttgtgccaggaagactgcgtgcagaaggtgactgtctcagtggagctgggtcatctcaggtggggagttggggtccccgaaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 144003 - DNA, 566 bp, Homo sapiens
  Payload ID: 8466
  Gene Symbol: IL32
  Gene Name: interleukin 32
  ENST ID: ENST00000525228
  CDS Start-End: 173-566
agactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtcctctctgatgacatgaagaagctgaaggcccgaatggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgt

SEQ ID NO: 144004 - DNA, 1112 bp, Homo sapiens
  Payload ID: 8466
  Gene Symbol: IL32
  Gene Name: interleukin 32
  Uniprot ID: P24001
  ENST ID: ENST00000534507
  CDS Start-End: 212-916
ccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 144005 - DNA, 1272 bp, Homo sapiens
  Payload ID: 8466
  Gene Symbol: IL32
  Gene Name: interleukin 32
  Uniprot ID: P24001
  ENST ID: ENST00000525643
  CDS Start-End: 333-899
gcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtatttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactgactcacagttccacatggctggggaagcctgaggaagcttacaatcatgggggaaggcggaa

SEQ ID NO: 144006 - DNA, 950 bp, Homo sapiens
  Payload ID: 8466
  Gene Symbol: IL32
  Gene Name: interleukin 32
  Uniprot ID: P24001
  ENST ID: ENST00000528163
  CDS Start-End: 187-753
gagactcccaccccagctcagagggagcaggggcccagccagggacggaccctcattcctcccagggaccccagacctctgtctctctcggctgagtatttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgat

SEQ ID NO: 144007 - DNA, 814 bp, Homo sapiens
  Payload ID: 8466
  Gene Symbol: IL32
  Gene Name: interleukin 32
  Uniprot ID: P24001
  ENST ID: ENST00000533097
  CDS Start-End: 71-637
aaaccagctgagtatttgtgccaggaagactgcgtgcagaaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccct

SEQ ID NO: 144008 - DNA, 746 bp, Homo sapiens
  Payload ID: 8466
  Gene Symbol: IL32
  Gene Name: interleukin 32
  Uniprot ID: P24001
  ENST ID: ENST00000531965
  CDS Start-End: 189-725
ctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgc

SEQ ID NO: 144009 - DNA, 774 bp, Homo sapiens
  Payload ID: 8466
  Gene Symbol: IL32
  Gene Name: interleukin 32
  Uniprot ID: P24001
  ENST ID: ENST00000530890
  CDS Start-End: 75-581
cataaaaccagctgagtatttgtgccaggaagactgcgtgcagaaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagatacca

SEQ ID NO: 144010 - DNA, 997 bp, Homo sapiens
  Payload ID: 8466
  Gene Symbol: IL32
  Gene Name: interleukin 32
  ENST ID: ENST00000525377
  CDS Start-End: 99-764
gactgcgtgcagaaggtgactgtctcagtggagctgggtcatctcaggtggggagttggggtccccgaaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctttgtcagagctcttcatgtcctctttccagtcctacggagccacacggggggcaaggaggagctgacaccccagaagtgctctgaaccccaatcctcaaaatgaagatactgacaccacctttgccctcccagtcaccgcgcacccaccctgacccctccctcagctgtcctgtgccccgccctctcccgcacactcagtccccctgcctggcattcctgccgcagctctgacctggcgctgtcgccctggcatcttaataaaacctgcttatacttccctggcaggggagataccatg

SEQ ID NO: 144011 - DNA, 674 bp, Homo sapiens
  Payload ID: 8466
  Gene Symbol: IL32
  Gene Name: interleukin 32
  Uniprot ID: P24001
  ENST ID: ENST00000530538
  CDS Start-End: 67-633
aaggtgactgtctcagtggagctgggtcatctcagcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacc

SEQ ID NO: 144012 - DNA, 672 bp, Homo sapiens
  Payload ID: 8466
  Gene Symbol: IL32
  Gene Name: interleukin 32
  ENST ID: ENST00000529699
  CDS Start-End: 166-672
actctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatga

SEQ ID NO: 144013 - DNA, 772 bp, Homo sapiens
  Payload ID: 8466
  Gene Symbol: IL32
  Gene Name: interleukin 32
  Uniprot ID: P24001
  ENST ID: ENST00000529550
  CDS Start-End: 193-759
ggggaaagcagcccattcctgggctcagagactcccaccccagctcagagggagcaggggcccagccagggacggaccctcattcctcccagggaccccagacctctgtctctctcggactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacacc

SEQ ID NO: 144014 - DNA, 812 bp, Homo sapiens
  Payload ID: 8466
  Gene Symbol: IL32
  Gene Name: interleukin 32
  Uniprot ID: P24001
  ENST ID: ENST00000548652
  CDS Start-End: 77-616
agactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 144015 - DNA, 623 bp, Homo sapiens
  Payload ID: 8466
  Gene Symbol: IL32
  Gene Name: interleukin 32
  Uniprot ID: P24001
  ENST ID: ENST00000552356
  CDS Start-End: 63-569
ggtcatctcaggtggggagttggggtccccgaaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccct

SEQ ID NO: 144016 - DNA, 713 bp, Homo sapiens
  Payload ID: 8466
  Gene Symbol: IL32
  Gene Name: interleukin 32
  ENST ID: ENST00000552936
  CDS Start-End: 55-693
gtctcagtggagctgggtcatctcaggccttggctccttgaacttttggccgccatgtgcttcccgaaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttg

SEQ ID NO: 144017 - DNA, 733 bp, Homo sapiens
  Payload ID: 8466
  Gene Symbol: IL32
  Gene Name: interleukin 32
  Uniprot ID: P24001
  ENST ID: ENST00000551122
  CDS Start-End: 147-542
gaaagcagcccattcctgggctcagagactcccaccccagctcagagggagcaggggcccagccagggacggaccctcattcctcccagggaccccagacctctgtctctctcggcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagatac

SEQ ID NO: 144018 - DNA, 654 bp, Homo sapiens
  Payload ID: 8466
  Gene Symbol: IL32
  Gene Name: interleukin 32
  Uniprot ID: P24001
  ENST ID: ENST00000549213
  CDS Start-End: 63-458
aggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 144019 - DNA, 447 bp, Homo sapiens
  Payload ID: 8466
  Gene Symbol: IL32
  Gene Name: interleukin 32
  Uniprot ID: P24001
  ENST ID: ENST00000548246
  CDS Start-End: 1-447
atgtgcttcccgaaggtcctctctgatgacatgaagaagctgaaggcccgaatggtgatgtcgagcctggcagagctggaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatga

SEQ ID NO: 144020 - DNA, 810 bp, Homo sapiens
  Payload ID: 8466
  Gene Symbol: IL32
  Gene Name: interleukin 32
  ENST ID: ENST00000548807
  CDS Start-End: 135-810
ttcctgggctcagagactcccaccccagctcagagggagcaggggcccagccagggacggaccctcattcctcccagggaccccagacctctgtctctctcggcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccaga

SEQ ID NO: 144021 - DNA, 731 bp, Homo sapiens
  Payload ID: 8466
  Gene Symbol: IL32
  Gene Name: interleukin 32
  Uniprot ID: P24001
  ENST ID: ENST00000552664
  CDS Start-End: 80-646
tctcagtggagctgggtcatctcaggtggggagttggggtccccgaagcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctccc

SEQ ID NO: 144022 - DNA, 791 bp, Homo sapiens
  Payload ID: 8466
  Gene Symbol: IL32
  Gene Name: interleukin 32
  ENST ID: ENST00000551513
  CDS Start-End: 101-778
tgaggaccctctggggaggagggtgcttctctgagacactttcttttcctcacacctgttcctcgccagcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacacc

SEQ ID NO: 144023 - DNA, 1014 bp, Homo sapiens
  Payload ID: 8466
  Gene Symbol: IL32
  Gene Name: interleukin 32
  Uniprot ID: P24001
  ENST ID: ENST00000548476
  CDS Start-End: 151-855
gtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaa

SEQ ID NO: 144024 - DNA, 1198 bp, Homo sapiens
  Payload ID: 8466
  Gene Symbol: IL32
  Gene Name: interleukin 32
  Uniprot ID: P24001
  ENST ID: ENST00000526464
  CDS Start-End: 444-1010
ggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtatttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggaga

SEQ ID NO: 144025 - DNA, 1033 bp, Homo sapiens
  Payload ID: 8466
  Gene Symbol: IL32
  Gene Name: interleukin 32
  ENST ID: ENST00000613483
  CDS Start-End: 215-721
ccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcggcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 144026 - DNA, 2641 bp, Homo sapiens
  Payload ID: 8467
  Gene Symbol: IL33
  Gene Name: interleukin 33
  Uniprot ID: O95760
  ENST ID: ENST00000381434
  CDS Start-End: 14-826
agaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgta

SEQ ID NO: 144027 - DNA, 2327 bp, Homo sapiens
  Payload ID: 8467
  Gene Symbol: IL33
  Gene Name: interleukin 33
  Uniprot ID: O95760
  ENST ID: ENST00000417746
  CDS Start-End: 79-513
agtctacagactcctccgaacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgt

SEQ ID NO: 144028 - DNA, 2501 bp, Homo sapiens
  Payload ID: 8467
  Gene Symbol: IL33
  Gene Name: interleukin 33
  Uniprot ID: O95760
  ENST ID: ENST00000456383
  CDS Start-End: 1-687
atgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgt

SEQ ID NO: 144029 - DNA, 757 bp, Homo sapiens
  Payload ID: 8467
  Gene Symbol: IL33
  Gene Name: interleukin 33
  Uniprot ID: O95760
  ENST ID: ENST00000611532
  CDS Start-End: 16-702
acagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaag

SEQ ID NO: 144030 - DNA, 1607 bp, Homo sapiens
  Payload ID: 8468
  Gene Symbol: IL34
  Gene Name: interleukin 34
  Uniprot ID: Q6ZMJ4
  ENST ID: ENST00000288098
  CDS Start-End: 384-1112
agcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactgagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtggagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagtggatgctcttccagtttcttttttctattaaacaccccacttcctttgg

SEQ ID NO: 144031 - DNA, 1779 bp, Homo sapiens
  Payload ID: 8468
  Gene Symbol: IL34
  Gene Name: interleukin 34
  Uniprot ID: Q6ZMJ4
  ENST ID: ENST00000429149
  CDS Start-End: 556-1284
catcagacgggaagcctggactgtgggttgggggcagcctcagcctctccaacctggcacccactgcccgtggcccttaggcacctgcttggggtcctggagccccttaaggccaccagcaaatcctaggagaccgagtcttggcacgtgaacagagccagatttcacactgagcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactgagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtggagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagtggatgctcttccagtttcttttttctattaaacaccccacttcctttgg

SEQ ID NO: 144032 - DNA, 703 bp, Homo sapiens
  Payload ID: 8468
  Gene Symbol: IL34
  Gene Name: interleukin 34
  ENST ID: ENST00000563721
  CDS Start-End: 542-703
cctggactgtgggttgggggcagcctcagcctctccaacctggcacccactgcccgtggcccttaggcacctgcttggggtcctggagccccttaaggccaccagcaaatcctaggagaccgagtcttggcacgtgaacagagccagatttcacactgagcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactgagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatg

SEQ ID NO: 144033 - DNA, 1001 bp, Homo sapiens
  Payload ID: 8468
  Gene Symbol: IL34
  Gene Name: interleukin 34
  ENST ID: ENST00000566361
  CDS Start-End: 266-919
attttatcaagttgaaaccagaatccaggatgattcgatctcctgaatgccgggctggaaaacccagcaacgagctttgaaaacatatcacccggacaccaggggcagaggctgttctgggcgggaggttgtgcctgccccacggagcgacagaagcggggagaccagacgtcgaccctgaggcgtgcctcctggggggctccagtggccggcatgggatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtggagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtg

SEQ ID NO: 144034 - DNA, 2672 bp, Homo sapiens
  Payload ID: 8469
  Gene Symbol: IL36RN
  Gene Name: interleukin 36 receptor antagonist
  Uniprot ID: Q9UBH0
  ENST ID: ENST00000346807
  CDS Start-End: 134-601
ggagagtcccacctctaacatctcctgtaggcctggcaatggcaggcaggaaagacagaggaaggaaggagggagaagggaaggagtgaaggaaggagtgaaaaaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaa

SEQ ID NO: 144035 - DNA, 2700 bp, Homo sapiens
  Payload ID: 8469
  Gene Symbol: IL36RN
  Gene Name: interleukin 36 receptor antagonist
  Uniprot ID: Q9UBH0
  ENST ID: ENST00000393200
  CDS Start-End: 162-629
cgctgggaatcctgctcctcctcaggtcctggcagtttcagggcccctccctaggccttacttaaaaggctgaggcatccttggaggaacaggcagactccacagctcccgccaggagaaaggaacattctgaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaa

SEQ ID NO: 144036 - DNA, 403 bp, Homo sapiens
  Payload ID: 8469
  Gene Symbol: IL36RN
  Gene Name: interleukin 36 receptor antagonist
  ENST ID: ENST00000437409
  CDS Start-End: 53-403
ttttctgttgtttattccaaaataggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccg

SEQ ID NO: 144037 - DNA, 675 bp, Homo sapiens
  Payload ID: 8469
  Gene Symbol: IL36RN
  Gene Name: interleukin 36 receptor antagonist
  ENST ID: ENST00000514072
  CDS Start-End: 1-158
acatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggaatgaactccagtgtccccacccaaaccctggggaatgggagcagaagccagaggaggagcccatatctgagccccaggtattccacctgcacttcacctgttggaccagcttggtggttgagagtccactgaggcactggcaaggaggtggccaggacagacaaggctgcctctatggacctcacagctccagcccagattcagctgaagtcctcaggcaacaggcagcacagctcctaccccaggcctctcagggctgccaagaacatgagctccggatgctaggctgtgtttcagaccctgttcacactctctttgtccatgggcccagacacagtcttgtgctgctccctctgcttttgggtcctccatccatcctctctgcctagataaatctctcatctttcaataccctgctaagatgtcacctcctccaagaagcttttactgagttgagacaccccca

SEQ ID NO: 144038 - DNA, 888 bp, Homo sapiens
  Payload ID: 8470
  Gene Symbol: IL36A
  Gene Name: interleukin 36, alpha
  Uniprot ID: Q9UHA7
  ENST ID: ENST00000259211
  CDS Start-End: 412-888
aaaacccaagtgcagtagaagccattgttcataatggtagggatacagggtccttcgtaacagattatcagtgtggcctatgctggaaagtctggtgacctctgattttttttgcttccaggtctttggccttggcactctttgtcatattagagttcctgggtctaggcctgggcaggattcataggtgcagctgcttctgctggaggtagactgcatccaacaaagtaagggtgctgggtgagttctgggagtatagattctgactggggtcactgctgggctggccgccagtctttcatctgacccagggttaaactgtggcttgggactgactcaggtcctctcttggggtcggtctgcacataaaaggactcctatccttggcagttctgaaacaacaccaccacaatggaaaaagcattgaaaattgacacacctcagcaggggagcattcaggatatcaatcatcgggtgtgggttcttcaggaccagacgctcatagcagtcccgaggaaggaccgtatgtctccagtcactattgccttaatctcatgccgacatgtggagacccttgagaaagacagagggaaccccatctacctgggcctgaatggactcaatctctgcctgatgtgtgctaaagtcggggaccagcccacactgcagctgaaggaaaaggatataatggatttgtacaaccaacccgagcctgtgaagtcctttctcttctaccacagccagagtggcaggaactccaccttcgagtctgtggctttccctggctggttcatcgctgtcagctctgaaggaggctgtcctctcatccttacccaagaactggggaaagccaacactactgactttgggttaactatgctgttttaa

SEQ ID NO: 144039 - DNA, 1186 bp, Homo sapiens
  Payload ID: 8471
  Gene Symbol: IL36B
  Gene Name: interleukin 36, beta
  Uniprot ID: Q9NZH7
  ENST ID: ENST00000259213
  CDS Start-End: 109-603
cacgggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaagcttcagggctcccaagataacatagggaaggacacttgctggaaactagttggaattcacacatgcataaacctggatgtgagagagagctgcttcatgggaacccttgaccaatggggaataggagtgggtagaaagaagtggaagagttcctttcaacatcaccatctcaggaagaaggacaaagatttctcatccatgcggaccaacataggaatgccaggaaggatgtagaaataaggggaggaagattcccatctctacaatctttgagtgggtttgctatcaatgaaatgctacaaatggaataagttgcagaaatttttctcttttcttgggttctggagagtttgtaaaacaaggacactatgtatttttaaagagttggtaaatcttacctgtaaagctagagaaggtcggagtctttttaggagtagatttggactacataacctgtaaatgtgttttgtccagtccttagagtgttttttaaaaaattgtaaagtcaaggttttcatgaaaaatgggaagatcagacaacattgctcctgaattcccacagagcagcaagctactagagctcaatctgttatttcttttcctgatgtacaggggttaagtcctatggaagaaacagcagaattattcaaaattatttacataatgtgcaattattcactagagcatgaggagtgaaacgctctgtttagtatgtataacttaaaaggaacacatacaattaaaagtaattgaaagacatttcttcttaaaaattctataatcttacactggtaaaataaactagtttttcccatgt

SEQ ID NO: 144040 - DNA, 1052 bp, Homo sapiens
  Payload ID: 8471
  Gene Symbol: IL36B
  Gene Name: interleukin 36, beta
  Uniprot ID: Q9NZH7
  ENST ID: ENST00000327407
  CDS Start-End: 109-582
cacgggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaaggaaaaaaatatcatggacctgtatgtggagaagaaagcacagaagccctttctctttttccacaataaagaaggctccacttctgtctttcagtcagtctcttaccctggctggttcatagccacctccaccacatcaggacagcccatctttctcaccaaggagagaggcataactaataacactaacttctacttagattctgtggaataaatccagcctaggctgtgggtggctggttccaggatagagaatcaagctgtcagagtcatcttaacagatcattatgcgactgagttcactagcagttcagcccatccatagcttacctcattcttactatccaaaagccacctcctcctccaaacatccatttctgtaccaagaccctcactcgaatgtcactatcccaagatgaaacctaaaaatcactttccattctttcttgatcttaccccaccatccactcagctgccatgcccagtttagtcaaccccccaaatgctgcttcatgcaaccttccattcctattccttttgccaacccatgatgtagagatgtggattcatgacattttgttcatacaacttcttcaataaaacattataatatgtgccccaaagataaagctgaagaatgagatgaatgtgaaattaaaggtttgcatgtctttctaatcctaa

SEQ ID NO: 144041 - DNA, 1195 bp, Homo sapiens
  Payload ID: 8472
  Gene Symbol: IL36G
  Gene Name: interleukin 36, gamma
  Uniprot ID: Q9NZH8
  ENST ID: ENST00000259205
  CDS Start-End: 70-579
gagccacgattcagtcccctggactgtagataaagaccctttcttgccaggtgctgagacaaccacactatgagaggcactccaggagacgctgatggtggaggaagggccgtctatcaatcaatgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggggcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataataataaagctaaaactgatataaaataaagaaagag

SEQ ID NO: 144042 - DNA, 989 bp, Homo sapiens
  Payload ID: 8472
  Gene Symbol: IL36G
  Gene Name: interleukin 36, gamma
  Uniprot ID: Q9NZH8
  ENST ID: ENST00000376489
  CDS Start-End: 80-484
gaagctgctggagccacgattcagtcccctggactgtagataaagaccctttcttgccaggtgctgagacaaccacactatgagaggcactccaggagacgctgatggtggaggaagggccgtctatcaatcaatcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggggcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttg

SEQ ID NO: 144043 - DNA, 369 bp, Homo sapiens
  Payload ID: 8472
  Gene Symbol: IL36G
  Gene Name: interleukin 36, gamma
  ENST ID: ENST00000447128
  CDS Start-End: 255-369
tttgctttcttgtccagtcttgggagtgcctgaccacagcaggatcttctggtaggaggagctggttttctttcatgtcatacgtttctcatgccccacccaggaagctggagcctccttctctgctcatccagataaatgatccaggctccattagaacccatcactgaccttggaagctgctggagccacgattcagtcccctggactgtagataaagaccctttcttgccaggtgctgagacaaccacactatgagaggcactccaggagacgctgatggtggaggaagggccgtctatcaatcaatgtgtaaacctattactgggactattaatgatttgaatcagcaagtgtggacccttcagg

SEQ ID NO: 144044 - DNA, 772 bp, Homo sapiens
  Payload ID: 8473
  Gene Symbol: IL37
  Gene Name: interleukin 37
  Uniprot ID: Q9NZH6
  ENST ID: ENST00000263326
  CDS Start-End: 43-699
cttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaagtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 144045 - DNA, 709 bp, Homo sapiens
  Payload ID: 8473
  Gene Symbol: IL37
  Gene Name: interleukin 37
  Uniprot ID: Q9NZH6
  ENST ID: ENST00000352179
  CDS Start-End: 43-636
cttcattccattttctgttgagtaataaactcaacgttgaaaatgtcctttgtgggggagaactcaggagtgaaaatgggctctgaggactgggaaaaagatgaaccccagtgctgcttagaaggtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 144046 - DNA, 589 bp, Homo sapiens
  Payload ID: 8473
  Gene Symbol: IL37
  Gene Name: interleukin 37
  Uniprot ID: Q9NZH6
  ENST ID: ENST00000349806
  CDS Start-End: 43-516
cttcattccattttctgttgagtaataaactcaacgttgaaaatgtcctttgtgggggagaactcaggagtgaaaatgggctctgaggactgggaaaaagatgaaccccagtgctgcttagaagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 144047 - DNA, 652 bp, Homo sapiens
  Payload ID: 8473
  Gene Symbol: IL37
  Gene Name: interleukin 37
  Uniprot ID: Q9NZH6
  ENST ID: ENST00000353225
  CDS Start-End: 43-579
cttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaaagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 144048 - DNA, 652 bp, Homo sapiens
  Payload ID: 8473
  Gene Symbol: IL37
  Gene Name: interleukin 37
  Uniprot ID: Q9NZH6
  ENST ID: ENST00000311328
  CDS Start-End: 1-579
atgtcaggctgtgataggagggaaacagaaaccaaaggaaagaacagctttaagaagcgcttaagaggtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 144049 - DNA, 616 bp, Homo sapiens
  Payload ID: 8474
  Gene Symbol: IL4
  Gene Name: interleukin 4
  Uniprot ID: P05112
  ENST ID: ENST00000231449
  CDS Start-End: 66-527
tgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatct

SEQ ID NO: 144050 - DNA, 414 bp, Homo sapiens
  Payload ID: 8474
  Gene Symbol: IL4
  Gene Name: interleukin 4
  Uniprot ID: P05112
  ENST ID: ENST00000350025
  CDS Start-End: 1-414
atgggtctcacctcccaactgcttccccctctgttcttcctgctagcatgtgccggcaactttgtccacggacacaagtgcgatatcaccttacaggagatcatcaaaactttgaacagcctcacagagcagaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctga

SEQ ID NO: 144051 - DNA, 717 bp, Homo sapiens
  Payload ID: 8474
  Gene Symbol: IL4
  Gene Name: interleukin 4
  ENST ID: ENST00000622422
  CDS Start-End: 66-476
tgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagcagcatgcatgtctgcccacctccagacacacaggcaccatctgccgccccccatcagcccgtgtcccttccacctcgactcgcctacaaagcccagagagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatct

SEQ ID NO: 144052 - DNA, 2349 bp, Homo sapiens
  Payload ID: 8475
  Gene Symbol: IL4I1
  Gene Name: interleukin 4 induced 1
  Uniprot ID: Q96RQ9
  ENST ID: ENST00000341114
  CDS Start-End: 564-2333
ggcccaccgtactacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaa

SEQ ID NO: 144053 - DNA, 1863 bp, Homo sapiens
  Payload ID: 8475
  Gene Symbol: IL4I1
  Gene Name: interleukin 4 induced 1
  Uniprot ID: Q96RQ9
  ENST ID: ENST00000391826
  CDS Start-End: 144-1847
gtttcccaaaaggaggggtgggcggggctctgccagtttaaggggagagaaagggccacagcagagacagtggagggcagtggagaggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaa

SEQ ID NO: 144054 - DNA, 2261 bp, Homo sapiens
  Payload ID: 8475
  Gene Symbol: IL4I1
  Gene Name: interleukin 4 induced 1
  ENST ID: ENST00000601717
  CDS Start-End: 441-689
gtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaa

SEQ ID NO: 144055 - DNA, 651 bp, Homo sapiens
  Payload ID: 8475
  Gene Symbol: IL4I1
  Gene Name: interleukin 4 induced 1
  ENST ID: ENST00000597295
  CDS Start-End: 439-651
gctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccggg

SEQ ID NO: 144056 - DNA, 506 bp, Homo sapiens
  Payload ID: 8475
  Gene Symbol: IL4I1
  Gene Name: interleukin 4 induced 1
  ENST ID: ENST00000593956
  CDS Start-End: 57-506
gaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctc

SEQ ID NO: 144057 - DNA, 747 bp, Homo sapiens
  Payload ID: 8475
  Gene Symbol: IL4I1
  Gene Name: interleukin 4 induced 1
  ENST ID: ENST00000596022
  CDS Start-End: 430-747
gctcgcgactccccaccccccagggctccctaaagagggccacgagctgcgaaagggcgggaaaggcagttggagaagagaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaag

SEQ ID NO: 144058 - DNA, 2407 bp, Homo sapiens
  Payload ID: 8475
  Gene Symbol: IL4I1
  Gene Name: interleukin 4 induced 1
  Uniprot ID: Q96RQ9
  ENST ID: ENST00000595948
  CDS Start-End: 622-2391
ggcccaccgtactacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagatgtttgaaagtttccataataaaacacttctgagaaagggggacctgcctttcacagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaa

SEQ ID NO: 144059 - DNA, 714 bp, Homo sapiens
  Payload ID: 8475
  Gene Symbol: IL4I1
  Gene Name: interleukin 4 induced 1
  ENST ID: ENST00000596011
  CDS Start-End: 618-714
gcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaacaccatctcccaccgagagtcatggccccattggccctgcacctcctcgtcctcgtccccatcctcctcagcctggtggcctcccaggactggaaggctgaacgcagccaagacccct

SEQ ID NO: 144060 - DNA, 3380 bp, Homo sapiens
  Payload ID: 8476
  Gene Symbol: IL4R
  Gene Name: interleukin 4 receptor
  Uniprot ID: P24394
  ENST ID: ENST00000170630
  CDS Start-End: 1-2433
atgcagaaggatgccagaagagaagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttt

SEQ ID NO: 144061 - DNA, 3685 bp, Homo sapiens
  Payload ID: 8476
  Gene Symbol: IL4R
  Gene Name: interleukin 4 receptor
  Uniprot ID: P24394
  ENST ID: ENST00000395762
  CDS Start-End: 260-2737
ctccgcgcccaggaaagccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 144062 - DNA, 3539 bp, Homo sapiens
  Payload ID: 8476
  Gene Symbol: IL4R
  Gene Name: interleukin 4 receptor
  Uniprot ID: P24394
  ENST ID: ENST00000543915
  CDS Start-End: 114-2591
aaagccccgcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 144063 - DNA, 594 bp, Homo sapiens
  Payload ID: 8476
  Gene Symbol: IL4R
  Gene Name: interleukin 4 receptor
  ENST ID: ENST00000563926
  CDS Start-End: 247-447
aaagccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaagggaacatgaaggtcttgcaggagcccacctgcgt

SEQ ID NO: 144064 - DNA, 379 bp, Homo sapiens
  Payload ID: 8476
  Gene Symbol: IL4R
  Gene Name: interleukin 4 receptor
  ENST ID: ENST00000561742
  CDS Start-End: 349-379
aaagccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctgggaagcctcttctcccactgcatctgtgatctctcctgaaatgtagcacccacacatccctgagaagctagctgcggcacgtgtgtgtgcacatgggcatgcgtgccttggcatctcccaatggggtggctttgctctgggctcctgttcc

SEQ ID NO: 144065 - DNA, 529 bp, Homo sapiens
  Payload ID: 8476
  Gene Symbol: IL4R
  Gene Name: interleukin 4 receptor
  ENST ID: ENST00000566117
  CDS Start-End: 169-529
gcagagttctccgctgggcgtgacctcgggctacggcgtgggaggaagcgcgcggcaagacacccagcgaggtgctggggtcgcccccaggagaggacggcggctcggactgtccggcggcggcggcggggacagcgacaggggcgcgaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatg

SEQ ID NO: 144066 - DNA, 2900 bp, Homo sapiens
  Payload ID: 8476
  Gene Symbol: IL4R
  Gene Name: interleukin 4 receptor
  ENST ID: ENST00000568746
  CDS Start-End: 106-306
gcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcct

SEQ ID NO: 144067 - DNA, 688 bp, Homo sapiens
  Payload ID: 8476
  Gene Symbol: IL4R
  Gene Name: interleukin 4 receptor
  ENST ID: ENST00000566318
  CDS Start-End: 102-476
ggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccg

SEQ ID NO: 144068 - DNA, 531 bp, Homo sapiens
  Payload ID: 8476
  Gene Symbol: IL4R
  Gene Name: interleukin 4 receptor
  ENST ID: ENST00000562968
  CDS Start-End: 1-148
gtgcgtgtgccacctgctcatggatgacgtggtcagtgcggataactatacactggacctgtgggctgggcagcagctgctgtggaagggctccttcaagcccagcgagcatgtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaa

SEQ ID NO: 144069 - DNA, 541 bp, Homo sapiens
  Payload ID: 8476
  Gene Symbol: IL4R
  Gene Name: interleukin 4 receptor
  ENST ID: ENST00000563002
  CDS Start-End: 181-541
cggacggcgaatggagcaggggcgcgcaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatg

SEQ ID NO: 144070 - DNA, 518 bp, Homo sapiens
  Payload ID: 8476
  Gene Symbol: IL4R
  Gene Name: interleukin 4 receptor
  ENST ID: ENST00000562142
  CDS Start-End: 328-518
aggaaagccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagct

SEQ ID NO: 144071 - DNA, 424 bp, Homo sapiens
  Payload ID: 8476
  Gene Symbol: IL4R
  Gene Name: interleukin 4 receptor
  ENST ID: ENST00000565352
  CDS Start-End: 1-402
cccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgact

SEQ ID NO: 144072 - DNA, 579 bp, Homo sapiens
  Payload ID: 8476
  Gene Symbol: IL4R
  Gene Name: interleukin 4 receptor
  ENST ID: ENST00000565179
  CDS Start-End: 1-579
ataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccccttcaagggacggcaggaggaggggtgttctggaaacgtggactgctggccaagccccctgagtttcactggtgtgtcagacactggaagaattgtcttaccaagctcttgccctgttttctggagcacaacatgaaaagggatgaagatcctcacaaggctgccaaagagatgcctttccagggctctggaaaatcagcat

SEQ ID NO: 144073 - DNA, 201 bp, Homo sapiens
  Payload ID: 8476
  Gene Symbol: IL4R
  Gene Name: interleukin 4 receptor
  ENST ID: ENST00000628578
  CDS Start-End: 1-201
atggggtggctttgctctgggctcctgttccctgtgagctgcctggtcctgctgcaggtggcaagctctggactcttcaggatgccgtgtggagaaaggaagagggtggaagccaggaggtctggagggaggtctggagtggaggagatgagaggctccggatccctctgggaggtagatttgaggacagattggaattga

SEQ ID NO: 144074 - DNA, 816 bp, Homo sapiens
  Payload ID: 8477
  Gene Symbol: IL5
  Gene Name: interleukin 5
  Uniprot ID: P05113
  ENST ID: ENST00000231454
  CDS Start-End: 45-449
atgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgagactctgaggattcctgttcctgtacataaaaatcaccaactgtgcactgaagaaatctttcagggaataggcacactggagagtcaaactgtgcaagggggtactgtggaaagactattcaaaaacttgtccttaataaagaaatacattgacggccaaaaaaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcagtataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttc

SEQ ID NO: 144075 - DNA, 276 bp, Homo sapiens
  Payload ID: 8477
  Gene Symbol: IL5
  Gene Name: interleukin 5
  ENST ID: ENST00000450655
  CDS Start-End: 124-276
gggcagcggacttccggatctttgctggggatgggcagcctggagaggcactgacttttggaaggggagaccaagacctgtgacggatggcgcttcccaaagcttgatcctgggactcctggaatgggggtagtggtggggtggattggagacccaggaagcgggactctgaggattcctgttcctgtacataaaaatcaccaactgtgcactgaagaaatctttcagggaataggcacactggagagtcaaactgtgcaagggggtactgtggaa

SEQ ID NO: 144076 - DNA, 2001 bp, Homo sapiens
  Payload ID: 8478
  Gene Symbol: IL5RA
  Gene Name: interleukin 5 receptor, alpha
  Uniprot ID: Q01344
  ENST ID: ENST00000256452
  CDS Start-End: 251-1513
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtgaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaa

SEQ ID NO: 144077 - DNA, 1328 bp, Homo sapiens
  Payload ID: 8478
  Gene Symbol: IL5RA
  Gene Name: interleukin 5 receptor, alpha
  Uniprot ID: Q01344
  ENST ID: ENST00000311981
  CDS Start-End: 251-1258
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtgaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtggggttctcaagataaaggagataacatccagctttcctgccccacaccgtatctgaaataaaaacaacagcagggatagcagatt

SEQ ID NO: 144078 - DNA, 1828 bp, Homo sapiens
  Payload ID: 8478
  Gene Symbol: IL5RA
  Gene Name: interleukin 5 receptor, alpha
  Uniprot ID: Q01344
  ENST ID: ENST00000383846
  CDS Start-End: 549-1556
agtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtggggttctcaagataaaggagataacatccagctttcctgccccacaccgtatctgaaataaaaacaacagcagggatagcagattacatgtgttttttaatttttatttattttgccaagcactatgctaaatacataatcttagtcctatcaaaaaacttgtttggaaagtttaggtaattggcttaactctgttctgcatggccaacaagtggcagggatggggctctaaccccagattaactgactctagcacttgatctctggacactctggcatggtgggac

SEQ ID NO: 144079 - DNA, 5521 bp, Homo sapiens
  Payload ID: 8478
  Gene Symbol: IL5RA
  Gene Name: interleukin 5 receptor, alpha
  ENST ID: ENST00000418488
  CDS Start-End: 645-1622
aaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtgaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatatcaccccatatcaaaagagacgacagattttgttcaaatattatattcttgaaggaagccttaatattctggaaatgtgctgaggaagtcattgagcataattcaatcatgaaagggaccactgaatcaagaatgaactttctgaagagatgtttgctgccaaagacttcagaacaacttgttggtcaagtaatgccagatcaatcctagtctctcaagtttggaaaagtttctacaaggccattccatcaaatatcccaatatacacagaaattcttcttcctaacatcttcatatatgagtctgcatccagattggaggcctttgtggtgggtggtggactgcaggtggaaccaagcacaggtgtgccctgggcagaggtgggcaagaggaaggaacccaaacagtgctgattccacatggcccttggtcaagaagctgaaggcctagaaaggaggtaacagtgcccagaatccccacctggcacactctttaaatgctttctggaggtgttttagtcagttttgatccatcggtggggacacactgactaccatatatttccaggtttgtttgttttcttaactaacctgtaattatccactgtaactagcagagggttgaaccctgggtaataggcacagaaacatcttgaatcttgacaagcctgcactgtcttatagtaatctgtattactgtcccattttatagttgcagttactaaggttcagagaagttgataggaaatggcatagtgaggagttgaataccaggctcaggtaaaagtgaccccagaaatgtgcagaggagtgtcagggaaagctgaggcctgcttaggggtgtggctgagaaggcaacacccatggaggtgctgcaatagttggcaaaatgtttaaaatgtttggtcactcaaatgattcataatctcaaacctgtttttgtttttttttttttttttttttgtggggtgggtggtggagacagtcttgttctgtctcccaggctagagtgtagtgatgtgatcttagctcactacaacctccctgtcctgggctcaagccatcctcctccctcaccctcccaagtagctgggactacaggtgcataacaccattcccagctcttttttgtatttttttttgtaaagctggggttttgccatgctgtctaggttcatctcgaactcctgggctcaagcgatacaccggcctcagccttccaaagtactgggattacaggcatgaaccaccattcctggccaggaaactgtatttgtaatgaacaccttaggtcagaatcagaggcgcctggagggctccttaagacacagaggagtgggctccattcttagagtctctaactgaataggtctgggtgaggtctgaaaagctgcgtttctaacaagttctcaggtgatgctcatgctgctggtctccaggacacactcggagaactgctgctccaggagagtcttatgaataccaaaatttgaaaatcagccgctgaaggaagatgtgacagaaaagtcctgtccccagaaaactgtccttttggggcggcttggagcaccctgtctgatctctttcaaaccacaacccagacagttggcattgtggaaactgcctctgcttaggaggcaggaacagaagcagggagctccccctccacaaatgtggccagctcttcagtgcttggtgtggtgcccacttcagactcctccctccactcagcagccatagatcacctgggctctgtggagctccttgccacacttccctgagctggtaccgttatctggcccttggtatatgtgtttcaggagcaacacaaagtagcccattggcctccttggtggattgggaactccttcctcccttcttgccctgtgcaactcatagtcattctttgggaacccgtaaccatcatcacttcctccatgaagccttcaaaagcagagttggttgatcccgcctctggattctcattctgggcctcatacccgtgttagagctactgcattgtagaatataccattaacagctgggaggcctcccctctagactgcggcttccaggaggatggagcttgtgtgaaatacgtctttttatctgcagtgtctaggacagtatctgacttaagaaaatataaatgtttcttaaaccctctgtcagccctgatacggcaccttgtatataggttagactgaacagtatttggcagagatcctcaaggcctacaataatgacagggggaggaagctgggtatctaatgagaatgcggttagttagaagcaaccaggagacacatgtgcctaacaactgggctactgcaacctggatgtttttgctgccaaagtgtctaaatggttatgtataaattgctgtgtaagaggcatttcagaagtggctcactgtgagtggtctatactgttctcaccagccttgtcatagcaagtcaaagagtttgaaattcacttaacagtaaacaccatcagcagcaggttgatgtaaggtaaagtcatgatattggctcccatctcttgccatctctcactaggacgagtgtagagagtcacttttctcctagagcctccacagccacgggatcagaacaaacatgcttttccaagatatccgttccaatagggatttttagcccaatttctttccttggcatttggaattcactgcgtgcagcatgggggagtgctggggagactggagggtgaaggtcacatttgccaacagcccgaccacctgagcctcattgaaatgcctcagacctcaagctattcatgcaggctggggaagaatccacgtgggcaaagaacatcctgattaaaaatccaaacgttttcatggtgagacttctatgtgtcaggaccatctgctggtggaattaagaagcctgaggtgctaatttgttaaagaaaaagtagatatctggaagtgagaacagagaactgaaaacaatctctgatggcacaagtaaaggtgaaaaacctaattagaataggacttggtgctagcctaaggactgtagctattcctgcttctacatccttcaaattgagtaccagggtgcaaattttttcaaaaccattccttcctttggaattttgtattgtactataagacaatcatgcttatctcctgttttgtaggtaatagatgtgaatataaatatgtttcagaatgagaaatattaaacataaatgacagtg

SEQ ID NO: 144080 - DNA, 2252 bp, Homo sapiens
  Payload ID: 8478
  Gene Symbol: IL5RA
  Gene Name: interleukin 5 receptor, alpha
  Uniprot ID: Q01344
  ENST ID: ENST00000438560
  CDS Start-End: 576-1712
aaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaataaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccac

SEQ ID NO: 144081 - DNA, 839 bp, Homo sapiens
  Payload ID: 8478
  Gene Symbol: IL5RA
  Gene Name: interleukin 5 receptor, alpha
  ENST ID: ENST00000427088
  CDS Start-End: 513-839
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataagggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactg

SEQ ID NO: 144082 - DNA, 1389 bp, Homo sapiens
  Payload ID: 8478
  Gene Symbol: IL5RA
  Gene Name: interleukin 5 receptor, alpha
  Uniprot ID: Q01344
  ENST ID: ENST00000456302
  CDS Start-End: 185-1186
ctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgcca

SEQ ID NO: 144083 - DNA, 788 bp, Homo sapiens
  Payload ID: 8478
  Gene Symbol: IL5RA
  Gene Name: interleukin 5 receptor, alpha
  ENST ID: ENST00000445701
  CDS Start-End: 200-788
tttgcaaaacgagactgttaataaaacctaccccagggtaggacggactgttcgggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgct

SEQ ID NO: 144084 - DNA, 1664 bp, Homo sapiens
  Payload ID: 8478
  Gene Symbol: IL5RA
  Gene Name: interleukin 5 receptor, alpha
  Uniprot ID: Q01344
  ENST ID: ENST00000430514
  CDS Start-End: 251-1252
ccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtgaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatattggtgtt

SEQ ID NO: 144085 - DNA, 2514 bp, Homo sapiens
  Payload ID: 8478
  Gene Symbol: IL5RA
  Gene Name: interleukin 5 receptor, alpha
  Uniprot ID: Q01344
  ENST ID: ENST00000446632
  CDS Start-End: 576-1838
aaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgccctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatat

SEQ ID NO: 144086 - DNA, 1182 bp, Homo sapiens
  Payload ID: 8479
  Gene Symbol: IL6
  Gene Name: interleukin 6
  Uniprot ID: P05231
  ENST ID: ENST00000258743
  CDS Start-End: 117-755
aatattagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagc

SEQ ID NO: 144087 - DNA, 765 bp, Homo sapiens
  Payload ID: 8479
  Gene Symbol: IL6
  Gene Name: interleukin 6
  ENST ID: ENST00000401630
  CDS Start-End: 40-609
acgaaagagaagctctatctcccctccaggagcccagctatgaactccttctccacaatacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaat

SEQ ID NO: 144088 - DNA, 926 bp, Homo sapiens
  Payload ID: 8479
  Gene Symbol: IL6
  Gene Name: interleukin 6
  ENST ID: ENST00000407492
  CDS Start-End: 87-497
cccaccgggaacgaaagagaagctctatctcccctccaggagcccagctatgaactccttctccacaaacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaa

SEQ ID NO: 144089 - DNA, 649 bp, Homo sapiens
  Payload ID: 8479
  Gene Symbol: IL6
  Gene Name: interleukin 6
  ENST ID: ENST00000406575
  CDS Start-End: 24-620
atctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaat

SEQ ID NO: 144090 - DNA, 1527 bp, Homo sapiens
  Payload ID: 8479
  Gene Symbol: IL6
  Gene Name: interleukin 6
  Uniprot ID: P05231
  ENST ID: ENST00000404625
  CDS Start-End: 460-1098
aggtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaa

SEQ ID NO: 144091 - DNA, 539 bp, Homo sapiens
  Payload ID: 8479
  Gene Symbol: IL6
  Gene Name: interleukin 6
  ENST ID: ENST00000401651
  CDS Start-End: 154-522
aatattagagtctcaacccccaataaatataggactggagatgtctgaggctcattctgccctcgagcccaccgggaacgaaagagaagctctatctcccctccaggagcccagctatgaactccttctccacaaacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattg

SEQ ID NO: 144092 - DNA, 574 bp, Homo sapiens
  Payload ID: 8479
  Gene Symbol: IL6
  Gene Name: interleukin 6
  ENST ID: ENST00000426291
  CDS Start-End: 117-574
aatattagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagtt

SEQ ID NO: 144093 - DNA, 3217 bp, Homo sapiens
  Payload ID: 8480
  Gene Symbol: IL6R
  Gene Name: interleukin 6 receptor
  Uniprot ID: P08887
  ENST ID: ENST00000344086
  CDS Start-End: 408-1505
ggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaa

SEQ ID NO: 144094 - DNA, 5914 bp, Homo sapiens
  Payload ID: 8480
  Gene Symbol: IL6R
  Gene Name: interleukin 6 receptor
  Uniprot ID: P08887
  ENST ID: ENST00000368485
  CDS Start-End: 438-1844
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaata

SEQ ID NO: 144095 - DNA, 570 bp, Homo sapiens
  Payload ID: 8480
  Gene Symbol: IL6R
  Gene Name: interleukin 6 receptor
  ENST ID: ENST00000515190
  CDS Start-End: 1-570
tcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggt

SEQ ID NO: 144096 - DNA, 527 bp, Homo sapiens
  Payload ID: 8480
  Gene Symbol: IL6R
  Gene Name: interleukin 6 receptor
  ENST ID: ENST00000512471
  CDS Start-End: 16-527
agccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttgtcagaacagtccggccgaagacttccaggagccgtgccagtattcccaggagtcccagaagttct

SEQ ID NO: 144097 - DNA, 881 bp, Homo sapiens
  Payload ID: 8480
  Gene Symbol: IL6R
  Gene Name: interleukin 6 receptor
  ENST ID: ENST00000476006
  CDS Start-End: 1-881
gaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacaggcttctctccacagaccatcccgggtggcatttgggacccagctggagaatccaggagtcctccagctgagaacgaggtgtccacccccatgcaggcacttactactaataaagacgatgataatattctcttcagagattctgcaaatgcgacaagcctccca

SEQ ID NO: 144098 - DNA, 1496 bp, Homo sapiens
  Payload ID: 8480
  Gene Symbol: IL6R
  Gene Name: interleukin 6 receptor
  ENST ID: ENST00000622330
  CDS Start-End: 438-1496
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagacaggctttctcctcgttgcccaggatggagtacagcagtgcaatcacagctcacggcaacttctgcctcctgggttcaagcaatcctcccgcctcagcctcctaagtag

SEQ ID NO: 144099 - DNA, 8776 bp, Homo sapiens
  Payload ID: 8481
  Gene Symbol: IL6ST
  Gene Name: interleukin 6 signal transducer
  Uniprot ID: P40189
  ENST ID: ENST00000336909
  CDS Start-End: 37-2793
tattacatgtgtctgttgcagaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacacacaaaaataaaagccaaaaaaaaacc

SEQ ID NO: 144100 - DNA, 201 bp, Homo sapiens
  Payload ID: 8481
  Gene Symbol: IL6ST
  Gene Name: interleukin 6 signal transducer
  ENST ID: ENST00000381286
  CDS Start-End: 1-201
atgttgacgttgcagacttggctagtgcaagccttgtttattttcctcaccactgaatctacagaattaaaaaacacatctggcctaatgttccagatccttcaaagagtcatattgcccagtggtcacctcacactcctccaaggcacaattttaattcaaaagatcaaatgtattcagatggcaatttcactgatgtaa

SEQ ID NO: 144101 - DNA, 8667 bp, Homo sapiens
  Payload ID: 8481
  Gene Symbol: IL6ST
  Gene Name: interleukin 6 signal transducer
  Uniprot ID: P40189
  ENST ID: ENST00000381287
  CDS Start-End: 37-1026
tattacatgtgtctgttgcagaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacac

SEQ ID NO: 144102 - DNA, 612 bp, Homo sapiens
  Payload ID: 8481
  Gene Symbol: IL6ST
  Gene Name: interleukin 6 signal transducer
  ENST ID: ENST00000381293
  CDS Start-End: 1-612
atgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaattgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataaattaaaaaacacatctggcctaatgttccagatccttcaaagagtcatattgcccagtggtcacctcacactcctccaaggcacaattttaattcaaaagatcaaatgtattcagatggcaatttcactgatgtaa

SEQ ID NO: 144103 - DNA, 2574 bp, Homo sapiens
  Payload ID: 8481
  Gene Symbol: IL6ST
  Gene Name: interleukin 6 signal transducer
  Uniprot ID: P40189
  ENST ID: ENST00000381294
  CDS Start-End: 1-2574
atgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtga

SEQ ID NO: 144104 - DNA, 9057 bp, Homo sapiens
  Payload ID: 8481
  Gene Symbol: IL6ST
  Gene Name: interleukin 6 signal transducer
  Uniprot ID: P40189
  ENST ID: ENST00000381298
  CDS Start-End: 314-3070
actggggtggcgcgctacctctgcggagaaggatctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatggaatgtgatttaaaagaaaaccagtacactatcttggtcttaataacatagaatggagatggcaaatttatccactagttttccagatttactatttaatagctgaggtctgaaatcgtagcatcctccctcctagtggacattaaaaaaaaaaaaaaaaaaaaaaacctacttggttgtcaagagcccaagtatggaggtgctgcgccatcttgtggcctgtctgtgcccaccctgcactctgctggagtctccatccttgttgcagtgagacttgaagttcaagattgatacatggcatcctcctgctacttcttgaggttactaagtagtatatgaaactaatcagtcagcaagtccacctggaaggaaaagaaaatctcaactattaatgtgccttcacattgtgattttgtctaaaaaaatgtagtgagtcaaaaaacccacaagccagccaacagtaactccttcacatatataccagagtttatagaaataacatgtcagctttgggctatgtgctcctttgtttaaaatcttctatttggttatggcttgtataggctcaagcctgatttctttaaggtgtggtggctcatcttatcctaatgtgtatgatagatacagtccatcctgctttggaaaagattatgtaactccttgagagcatactctttctctagcccaaaggcagtgagagagttttcttgttcaggattgcttaactttccatttaagctttttctttttaaattaatacaaacttctacactttcaaaatacgaaatatattacaactgcgtataggctcttccatacttaagtccagtgcttgggcaagttaatggagtgaaagactacaagcaaagaggaactgaggtagaaaaagaagaatgtgtgaaagcagcaggaagctcagccaactcgaaagcagggtgaacagcttgagtcctgttgctgctgatcggggttggctcttggacaacttagtaagatcatggaaaggctgcttgggttctccatagaaaagttctgtctccatcaagggaggaaaatgtacctttcaactcaaaattcaatatttgtttttaaatatagctattttccccaaccgctaaagattttcaacagatacgaagccagagcttagttttagaaacctgtggacattcaaacctgattctttattccctgtgactatggttatgtcattttacatgtcaaaaaagtgtatctagaattgtcatttcttatttttgagctttttttagtgagaattatcccctcacttaaatggctttttatttaaacatctgtgcattctgtatgaaattgtagtctttctgggataacatggtgagctatatggtggtaatccacacacacaaaaataaaagccaaaaaaaaaccaaaa

SEQ ID NO: 144105 - DNA, 3031 bp, Homo sapiens
  Payload ID: 8481
  Gene Symbol: IL6ST
  Gene Name: interleukin 6 signal transducer
  ENST ID: ENST00000503773
  CDS Start-End: 113-1114
cggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatacacttgataagcccctgggaagcggttgatcctggaattttggttggaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgccc

SEQ ID NO: 144106 - DNA, 1878 bp, Homo sapiens
  Payload ID: 8481
  Gene Symbol: IL6ST
  Gene Name: interleukin 6 signal transducer
  Uniprot ID: P40189
  ENST ID: ENST00000522633
  CDS Start-End: 93-1082
ggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtg

SEQ ID NO: 144107 - DNA, 3007 bp, Homo sapiens
  Payload ID: 8481
  Gene Symbol: IL6ST
  Gene Name: interleukin 6 signal transducer
  Uniprot ID: P40189
  ENST ID: ENST00000502326
  CDS Start-End: 197-2953
aggatctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaa

SEQ ID NO: 144108 - DNA, 168 bp, Homo sapiens
  Payload ID: 8481
  Gene Symbol: IL6ST
  Gene Name: interleukin 6 signal transducer
  ENST ID: ENST00000396816
  CDS Start-End: 1-168
atgttgacgttgcagacttggctagtgcaagccttgtttattttcctcaccactgaatctacagggcaacacacaagtttgctgattgcaaagcaaaacgtgacacccccacctcatgcactgttgattattctactgtgtattttgtcaacattgaagtctgggtag

SEQ ID NO: 144109 - DNA, 2076 bp, Homo sapiens
  Payload ID: 8482
  Gene Symbol: IL7
  Gene Name: interleukin 7
  Uniprot ID: P13232
  ENST ID: ENST00000263851
  CDS Start-End: 602-1135
acatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgtattaa

SEQ ID NO: 144110 - DNA, 1888 bp, Homo sapiens
  Payload ID: 8482
  Gene Symbol: IL7
  Gene Name: interleukin 7
  ENST ID: ENST00000379113
  CDS Start-End: 602-949
acatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgtatt

SEQ ID NO: 144111 - DNA, 456 bp, Homo sapiens
  Payload ID: 8482
  Gene Symbol: IL7
  Gene Name: interleukin 7
  Uniprot ID: P13232
  ENST ID: ENST00000520269
  CDS Start-End: 7-408
cagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctcc

SEQ ID NO: 144112 - DNA, 1055 bp, Homo sapiens
  Payload ID: 8482
  Gene Symbol: IL7
  Gene Name: interleukin 7
  ENST ID: ENST00000520317
  CDS Start-End: 530-643
tccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctcc

SEQ ID NO: 144113 - DNA, 400 bp, Homo sapiens
  Payload ID: 8482
  Gene Symbol: IL7
  Gene Name: interleukin 7
  ENST ID: ENST00000520215
  CDS Start-End: 7-120
cagaccatgttccatgtttcttttaggtatatctttggacttcctcccctgatccttgttctgttgccagtagcatcatctgattgtgatattgaaggacagcatgaaagaaattggtagcaattgcctgaataatgaatttaacttttttaaaagacatatctgtgatgctaataaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctcc

SEQ ID NO: 144114 - DNA, 1940 bp, Homo sapiens
  Payload ID: 8482
  Gene Symbol: IL7
  Gene Name: interleukin 7
  ENST ID: ENST00000518982
  CDS Start-End: 543-758
cacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattgaatcagccctacaaaaagaaagaaaaaagaacagaaaggaagcagcaatcagctatgagcaataattagacattcgtttgctagctctagcacatgtgaccatgaagagtaactgtgaaccatattgactttctctcctgaaaagaaaaatatgaaaaaaattcagaagaaaactgtcctatcacaaagaatacagaaattgggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttgaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaa

SEQ ID NO: 144115 - DNA, 2020 bp, Homo sapiens
  Payload ID: 8482
  Gene Symbol: IL7
  Gene Name: interleukin 7
  ENST ID: ENST00000541183
  CDS Start-End: 602-1081
acatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgtatt

SEQ ID NO: 144116 - DNA, 4626 bp, Homo sapiens
  Payload ID: 8483
  Gene Symbol: IL7R
  Gene Name: interleukin 7 receptor
  Uniprot ID: P16871
  ENST ID: ENST00000303115
  CDS Start-End: 130-1509
gtggttagataagtataaagccctagatctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttggtttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaagatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctcttgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaaca

SEQ ID NO: 144117 - DNA, 1004 bp, Homo sapiens
  Payload ID: 8483
  Gene Symbol: IL7R
  Gene Name: interleukin 7 receptor
  ENST ID: ENST00000506850
  CDS Start-End: 88-873
cttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggattaagcctatcgtatggcccagtctccccgatcataagaagactctggaacatctttgtaagaaaccaagaaaagtgagtgtttttggtgcttaaaaagtgttgtgttggcaacatcccagtggccaagaatgatattccaggacaaggaacagttgaacctcaccttttggtatttgattcatcctgtaactagggtccctcctaaga

SEQ ID NO: 144118 - DNA, 612 bp, Homo sapiens
  Payload ID: 8483
  Gene Symbol: IL7R
  Gene Name: interleukin 7 receptor
  ENST ID: ENST00000511982
  CDS Start-End: 87-539
ttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactataggtaagaagttgtatataaaagtatggttgtcacttttgggctacctgaaaacactgtgtctggacattctgtaggttaaaagtagacaaatagtggaaacaactggcaatagataatagctaattccctactgtaaatttttataat

SEQ ID NO: 144119 - DNA, 551 bp, Homo sapiens
  Payload ID: 8483
  Gene Symbol: IL7R
  Gene Name: interleukin 7 receptor
  ENST ID: ENST00000515665
  CDS Start-End: 395-551
cttttaaagtgggcccttagtcaggagcggtggctcatgcctgtagtcctagcactttgggaggctgaggcaggcagatcacttgaggtcaggagttcgagacaagcctggccaacatggcgaaaccccgtctccactgaaaacacaaaaattaggctggcatagtggcatttgcctgtagtcctagctactcaggaggctgaggcaggagaattgcttgaacctgggaggtggaaattgcagtgagccgagatcatgctattgtactccagcctgggcaacaaagcaagactctgtctcaaaaaaataaaaattaaaaaaataaagtagcctctagcctaagatagcttgagcctaggtgtgaatctactgccttactctgatgtaagcacaaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagc

SEQ ID NO: 144120 - DNA, 917 bp, Homo sapiens
  Payload ID: 8483
  Gene Symbol: IL7R
  Gene Name: interleukin 7 receptor
  ENST ID: ENST00000505093
  CDS Start-End: 1-198
gcagcaatgtatgagattaaagttcgatccatccctgatcactattttaaaggcttctggagtgaatggagtccaagttattacttcagaactccagagatcaataatagctcaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtca

SEQ ID NO: 144121 - DNA, 562 bp, Homo sapiens
  Payload ID: 8483
  Gene Symbol: IL7R
  Gene Name: interleukin 7 receptor
  ENST ID: ENST00000508941
  CDS Start-End: 384-562
aaatgctagagactattcatttaggaccagagtggcattagctttcctacagccatcctcacctgcttgacacccttggatgttgggtttttttgtttgtttgtttgtttgtttgttgttttttttttccacagctcttgtggtccccagcctctctcttgagcagggctggctttttttttttaataagatagctggtgcccaagattgttttccaccttaaggataaaacctgttaagaaaggtcatagtttgccagcccctgccctaaacaaataattcttgaatgcctactgtggtgtgtaagatatgagtaaataccagggatacacagagaacaaaagagaaaaactgctattcttgtgaaacttggaagttggagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttga

SEQ ID NO: 144122 - DNA, 1287 bp, Homo sapiens
  Payload ID: 8483
  Gene Symbol: IL7R
  Gene Name: interleukin 7 receptor
  ENST ID: ENST00000514217
  CDS Start-End: 90-632
gtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctca

SEQ ID NO: 144123 - DNA, 591 bp, Homo sapiens
  Payload ID: 8484
  Gene Symbol: IL9
  Gene Name: interleukin 9
  Uniprot ID: P15248
  ENST ID: ENST00000274520
  CDS Start-End: 12-446
ccgctgtcaagatgcttctggccatggtccttacctctgccctgctcctgtgctccgtggcaggccaggggtgtccaaccttggcggggatcctggacatcaacttcctcatcaacaagatgcaggaagatccagcttccaagtgccactgcagtgctaatgtgaccagttgtctctgtttgggcattccctctgacaactgcaccagaccatgcttcagtgagagactgtctcagatgaccaataccaccatgcaaacaagatacccactgattttcagtcgggtgaaaaaatcagttgaagtactaaagaacaacaagtgtccatatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaat

SEQ ID NO: 144124 - DNA, 1944 bp, Homo sapiens
  Payload ID: 8485
  Gene Symbol: IL9R
  Gene Name: interleukin 9 receptor
  Uniprot ID: Q01113
  ENST ID: ENST00000244174
  CDS Start-End: 180-1745
agcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgttaagctggacccgccctctgacttgcagagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagggtgaagagaatcttctaccagaacgtgccctctccagcgatgttcttccagcccctctacagtgtacacaatgggaacttccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctgg

SEQ ID NO: 144125 - DNA, 2032 bp, Homo sapiens
  Payload ID: 8485
  Gene Symbol: IL9R
  Gene Name: interleukin 9 receptor
  Uniprot ID: Q01113
  ENST ID: ENST00000369423
  CDS Start-End: 39-1067
cagagatagttgggtgacaaatcacctccaggttggggatgcctcagacttgtgatgggactgggcagatgcatctgggaagtaactgctgcaagaacggacagacactgctgcagagaacttgccacggtgtttcatgctgtggctggtggttccaggctgcacgctccattctaggaaaggggccctcagcccagtcccttgcaggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagacttggatgggggcccacggggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgtt

SEQ ID NO: 144126 - DNA, 1659 bp, Homo sapiens
  Payload ID: 8486
  Gene Symbol: ILF2
  Gene Name: interleukin enhancer binding factor 2
  Uniprot ID: Q12905
  ENST ID: ENST00000361891
  CDS Start-End: 127-1299
gggtaaggcgggagccaatcgcaccgggttttattgggacacgccggcaagacgcctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagg

SEQ ID NO: 144127 - DNA, 726 bp, Homo sapiens
  Payload ID: 8486
  Gene Symbol: ILF2
  Gene Name: interleukin enhancer binding factor 2
  ENST ID: ENST00000368681
  CDS Start-End: 61-513
tctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgtgtgagtgtgcctgtttctggtcatgggaacagaacatagcacttggattaggggtttaggtatctttttttgttttgagacaaattctccctccgttggccaggctggagtgcagtggtaccattgtagctcactgcagccttgacctccactacagcaagtgatcttcccgccttagcctcccgagtagctgggactacagatgtgtgctaccacacccagctaatttttgtattttttgtagatacagggtttcaccgtgttgctcgggc

SEQ ID NO: 144128 - DNA, 476 bp, Homo sapiens
  Payload ID: 8486
  Gene Symbol: ILF2
  Gene Name: interleukin enhancer binding factor 2
  ENST ID: ENST00000368684
  CDS Start-End: 131-476
aggggtgacagaggccgtggtcgtggtgggcgctttggttccagaggaggcccaggaggagggttcaggccctttgtaccacatatcccatttgacttctatttgttgtttacttctggtttagtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaag

SEQ ID NO: 144129 - DNA, 1906 bp, Homo sapiens
  Payload ID: 8486
  Gene Symbol: ILF2
  Gene Name: interleukin enhancer binding factor 2
  ENST ID: ENST00000615950
  CDS Start-End: 240-1298
gcaccgggttttattgggacacgccggcaagacgcctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgttgtttacttctggtttagtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgaggattcgttttcctggctttgagcccctcacaccctggatccttgacctactaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctttctggttggtgttttttgtttgtttgtttttttgcatgtggcaaccttttttgcttttggctttgtgtactcttttgttgaaaatgataattgagtcatttaattataaatactcagatcacaatttgaagctgtctttgaattaaaggacaaactcctggaacctttccatataccagagtaaactagaatatcattttaagtatttattgaataaaatgattctatcaacactg

SEQ ID NO: 144130 - DNA, 3035 bp, Homo sapiens
  Payload ID: 8487
  Gene Symbol: ILF3
  Gene Name: interleukin enhancer binding factor 3, 90kDa
  Uniprot ID: Q12906
  ENST ID: ENST00000250241
  CDS Start-End: 70-2142
aaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacacaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaa

SEQ ID NO: 144131 - DNA, 3671 bp, Homo sapiens
  Payload ID: 8487
  Gene Symbol: ILF3
  Gene Name: interleukin enhancer binding factor 3, 90kDa
  Uniprot ID: Q12906
  ENST ID: ENST00000407004
  CDS Start-End: 251-2371
cgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaa

SEQ ID NO: 144132 - DNA, 6119 bp, Homo sapiens
  Payload ID: 8487
  Gene Symbol: ILF3
  Gene Name: interleukin enhancer binding factor 3, 90kDa
  Uniprot ID: Q12906
  ENST ID: ENST00000449870
  CDS Start-End: 318-3014
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcagggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactc

SEQ ID NO: 144133 - DNA, 533 bp, Homo sapiens
  Payload ID: 8487
  Gene Symbol: ILF3
  Gene Name: interleukin enhancer binding factor 3, 90kDa
  ENST ID: ENST00000587941
  CDS Start-End: 166-533
agtttgcttgtccctccttggttcttcagttgtgctcctgcaggctttgcttttacacacgagcgatatagcatcattctgaattgtgcagcttaaaagatgaacgttgggctgcttgctctctttacatcatttttaacttaattctcacatccctagcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctgga

SEQ ID NO: 144134 - DNA, 2622 bp, Homo sapiens
  Payload ID: 8487
  Gene Symbol: ILF3
  Gene Name: interleukin enhancer binding factor 3, 90kDa
  Uniprot ID: Q12906
  ENST ID: ENST00000589998
  CDS Start-End: 218-2326
cttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatc

SEQ ID NO: 144135 - DNA, 3866 bp, Homo sapiens
  Payload ID: 8487
  Gene Symbol: ILF3
  Gene Name: interleukin enhancer binding factor 3, 90kDa
  Uniprot ID: Q12906
  ENST ID: ENST00000592763
  CDS Start-End: 1-2097
atgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggccctcgacccccaccccttcccggccccacagtgggattgattgtgttaatacacgaactcgtgtaactgcaaagttccttaaaagttagaattttaaatttctctgctttaagccatgcgaagcaccaatcttgtgaatacgcttttccggccagtgcacagctcttgtcttgagaaggagccttcattggggggttacaggagcagagaaatctaaaacatgaatttcaaatgtggcgctctgtgccctttttcaaaagaattctaatttcttctctctgctctgtctcccccttttgtaggtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaa

SEQ ID NO: 144136 - DNA, 953 bp, Homo sapiens
  Payload ID: 8487
  Gene Symbol: ILF3
  Gene Name: interleukin enhancer binding factor 3, 90kDa
  ENST ID: ENST00000590009
  CDS Start-End: 191-953
ggcgggaaaagtcgcctcctttgtcctcacaggtcgcggagaggcggaccccctccttggaagccccttcccacgcggattgctgaggaagcctttgtggagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgt

SEQ ID NO: 144137 - DNA, 773 bp, Homo sapiens
  Payload ID: 8487
  Gene Symbol: ILF3
  Gene Name: interleukin enhancer binding factor 3, 90kDa
  ENST ID: ENST00000589416
  CDS Start-End: 1-476
tgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaaga

SEQ ID NO: 144138 - DNA, 531 bp, Homo sapiens
  Payload ID: 8487
  Gene Symbol: ILF3
  Gene Name: interleukin enhancer binding factor 3, 90kDa
  ENST ID: ENST00000590869
  CDS Start-End: 1-351
ggtggcgccaaccatggaggctacatgaatgccggtgctgggtatggaagctatgggtacggaggcaactcggcgacagcaggctacaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagc

SEQ ID NO: 144139 - DNA, 599 bp, Homo sapiens
  Payload ID: 8487
  Gene Symbol: ILF3
  Gene Name: interleukin enhancer binding factor 3, 90kDa
  ENST ID: ENST00000589283
  CDS Start-End: 301-599
gaccccccttcctcactccttccctaccccctcctcctctttgtcccggtcccgcccccgattccaggagagtcccaggttcccgaggcgggaaaagtcgcctcctttgtcctcacaggtcgcggagaggcggaccccctccttggaagccccttcccacgcggattgctgaggaagcctttgtgggttcgtcgggtttccaaatctctgagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaa

SEQ ID NO: 144140 - DNA, 475 bp, Homo sapiens
  Payload ID: 8487
  Gene Symbol: ILF3
  Gene Name: interleukin enhancer binding factor 3, 90kDa
  ENST ID: ENST00000593061
  CDS Start-End: 1-340
agggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacatgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacaga

SEQ ID NO: 144141 - DNA, 791 bp, Homo sapiens
  Payload ID: 8487
  Gene Symbol: ILF3
  Gene Name: interleukin enhancer binding factor 3, 90kDa
  ENST ID: ENST00000587505
  CDS Start-End: 95-334
atagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctgggctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgc

SEQ ID NO: 144142 - DNA, 620 bp, Homo sapiens
  Payload ID: 8487
  Gene Symbol: ILF3
  Gene Name: interleukin enhancer binding factor 3, 90kDa
  ENST ID: ENST00000589485
  CDS Start-End: 1-222
gatgctgcgattgtgataaaaaacacaaaagagcctccattgtccctgaccatccacctgacatcccctgttgtcagagaagaaatggagaaagtattagctggaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaaga

SEQ ID NO: 144143 - DNA, 655 bp, Homo sapiens
  Payload ID: 8487
  Gene Symbol: ILF3
  Gene Name: interleukin enhancer binding factor 3, 90kDa
  ENST ID: ENST00000587840
  CDS Start-End: 1-168
ccaacacaagaggagctggaggcagtccagaacatggtgtcccacacggagcgggcgctcaaagctgtgtccgactggatagacgagcaggaaaagggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaa

SEQ ID NO: 144144 - DNA, 849 bp, Homo sapiens
  Payload ID: 8487
  Gene Symbol: ILF3
  Gene Name: interleukin enhancer binding factor 3, 90kDa
  ENST ID: ENST00000585835
  CDS Start-End: 1-541
gcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgt

SEQ ID NO: 144145 - DNA, 637 bp, Homo sapiens
  Payload ID: 8487
  Gene Symbol: ILF3
  Gene Name: interleukin enhancer binding factor 3, 90kDa
  ENST ID: ENST00000589052
  CDS Start-End: 91-330
agttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctgggctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccac

SEQ ID NO: 144146 - DNA, 839 bp, Homo sapiens
  Payload ID: 8487
  Gene Symbol: ILF3
  Gene Name: interleukin enhancer binding factor 3, 90kDa
  ENST ID: ENST00000589600
  CDS Start-End: 355-839
cccagcagcccggcgcgcaccgcgtggcttttgggggcagaccccggcgggctgtggcaggagggcggcggcggcggctgcggtcgaagaaggggacgccgacaagccagtgggacacctcacaagtcagctccgatgtcctcaggacaagactgctatagtcaccagtgctttgttgctttctggcgctccggtaggatccaggctcacttggtatatcccctgctgcagattacggtccacttctcccgggagctgctttcaagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaaga

SEQ ID NO: 144147 - DNA, 3219 bp, Homo sapiens
  Payload ID: 8487
  Gene Symbol: ILF3
  Gene Name: interleukin enhancer binding factor 3, 90kDa
  Uniprot ID: Q12906
  ENST ID: ENST00000590261
  CDS Start-End: 1-2685
atgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaact

SEQ ID NO: 144148 - DNA, 2697 bp, Homo sapiens
  Payload ID: 8487
  Gene Symbol: ILF3
  Gene Name: interleukin enhancer binding factor 3, 90kDa
  Uniprot ID: Q12906
  ENST ID: ENST00000588657
  CDS Start-End: 1-2697
atgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataa

SEQ ID NO: 144149 - DNA, 413 bp, Homo sapiens
  Payload ID: 8487
  Gene Symbol: ILF3
  Gene Name: interleukin enhancer binding factor 3, 90kDa
  ENST ID: ENST00000593199
  CDS Start-End: 181-413
acatttccaacattgtttgccagttgctgcttaggtgacatggatcagcaacgaagcgtcggtttcagtggtttctttttctggactccgagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctgg

SEQ ID NO: 144150 - DNA, 2358 bp, Homo sapiens
  Payload ID: 8488
  Gene Symbol: IRAK1
  Gene Name: interleukin-1 receptor-associated kinase 1
  ENST ID: ENST00000369973
  CDS Start-End: 86-1105
agtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcagg

SEQ ID NO: 144151 - DNA, 3319 bp, Homo sapiens
  Payload ID: 8488
  Gene Symbol: IRAK1
  Gene Name: interleukin-1 receptor-associated kinase 1
  Uniprot ID: P51617
  ENST ID: ENST00000369974
  CDS Start-End: 65-1966
cccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaat

SEQ ID NO: 144152 - DNA, 3666 bp, Homo sapiens
  Payload ID: 8488
  Gene Symbol: IRAK1
  Gene Name: interleukin-1 receptor-associated kinase 1
  Uniprot ID: P51617
  ENST ID: ENST00000369980
  CDS Start-End: 169-2307
gcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcggg

SEQ ID NO: 144153 - DNA, 2049 bp, Homo sapiens
  Payload ID: 8488
  Gene Symbol: IRAK1
  Gene Name: interleukin-1 receptor-associated kinase 1
  Uniprot ID: P51617
  ENST ID: ENST00000393687
  CDS Start-End: 1-2049
atggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctga

SEQ ID NO: 144154 - DNA, 2127 bp, Homo sapiens
  Payload ID: 8488
  Gene Symbol: IRAK1
  Gene Name: interleukin-1 receptor-associated kinase 1
  ENST ID: ENST00000429936
  CDS Start-End: 1-2127
atggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctga

SEQ ID NO: 144155 - DNA, 1125 bp, Homo sapiens
  Payload ID: 8488
  Gene Symbol: IRAK1
  Gene Name: interleukin-1 receptor-associated kinase 1
  ENST ID: ENST00000444230
  CDS Start-End: 1-705
ccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaa

SEQ ID NO: 144156 - DNA, 1175 bp, Homo sapiens
  Payload ID: 8488
  Gene Symbol: IRAK1
  Gene Name: interleukin-1 receptor-associated kinase 1
  ENST ID: ENST00000443220
  CDS Start-End: 1-1175
gatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaag

SEQ ID NO: 144157 - DNA, 862 bp, Homo sapiens
  Payload ID: 8488
  Gene Symbol: IRAK1
  Gene Name: interleukin-1 receptor-associated kinase 1
  ENST ID: ENST00000437278
  CDS Start-End: 1-830
ttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccgg

SEQ ID NO: 144158 - DNA, 783 bp, Homo sapiens
  Payload ID: 8488
  Gene Symbol: IRAK1
  Gene Name: interleukin-1 receptor-associated kinase 1
  ENST ID: ENST00000444254
  CDS Start-End: 1-655
tggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagaga

SEQ ID NO: 144159 - DNA, 784 bp, Homo sapiens
  Payload ID: 8488
  Gene Symbol: IRAK1
  Gene Name: interleukin-1 receptor-associated kinase 1
  ENST ID: ENST00000455690
  CDS Start-End: 1-639
cagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggct

SEQ ID NO: 144160 - DNA, 5656 bp, Homo sapiens
  Payload ID: 8489
  Gene Symbol: IRAK1BP1
  Gene Name: interleukin-1 receptor-associated kinase 1 binding protein 1
  Uniprot ID: Q5VVH5
  ENST ID: ENST00000369940
  CDS Start-End: 106-888
ccatcccggcatactttgcgccgtgcacaggcaagccctggtgcgcattggccccttcggccgccgtcggccggtagttactatggaaacccagctgccatcgctatgtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgaggtaaagggaaaagagaagagaaaaaagcacctttgaaattccaaacaaattatattgtacttgtatctttttacctatttttatactttttataatgtttacgtttgtcctgaatatatatatatatatatatatatatatatatatggtataggagataagctatttctttccaaaatctataaatctttgaatatagtcccacagaatacttatgttcactttctatttttaaaagactactctgaaaaacactcttggataataaatgtattatgtgcatacttatatactgacagttcatacaagcacatgtgtaatatttctattataaggacagatattgacccttgcatttcataatttttaaagatatttaagctaaaattttctcagccacatttttatataaaaccaaattttatgtaaaaactaggcttcaataagttagctaaattttttaaattgtaagacaaaatttttatggaaaagaattcctatatcccatcaaacctaataattttccacaactaaaaatgagtataaatacataattttaagtgcatcctgtcaggtctgatatttaattttactttagttagaagctaagtagttaccctgttacttcttcatggatgctaacagaagacttgagattcccagacagaaacaaaggactattactcatggcacaacaaggagcatgagcatcagcacattctcattgcttccccttgtcccaggtcccatgggggcaaaatgatatggccatatgcaatatggctacatatacagcaggcttttgttgtaggtaaagaatactgagcttggagggttcactgctttttatccatgaacagaagcaaacctgctctttgcctcatcccttatagatgctcactcaaaactcaatactgagaaatggcccaggtaaagaacagccaaggtctttcatgcttgccacacccagcaatatgtttaggaaggtgaagtctactgagggctatctcacatctaacagtttctttactaggaccagagaccattttggtaagatgcagataacaaccccaaccttaacaacttcacaacatgaatagaaatagtgataaataattcatagctttttacaaaagaataatgaggtataataggaaaatgttttgatgccaaaaataaaagagttaatgtttggatcggactccaacagggctccttagagtgatacaaatacaaagcaaacgatatgtgtaatttaaaatttcctagtgcacatgtttttttatttttctttttcgagatggagtctttctctgtcgcccaagctggagtgcagtggtacgatctcagctcactgcaacctctgcctcctgaatttaagcgattctcctgcctcagcctcccaagtagctgggattacaggcgtgagccactgcatctggccctgtacgcacatttttaaaaataaaactttaaaaaagaaacagttgaaactaattttaataacattttatttaaccaaatatatcaaaaatattatttcagcatgtaatcagtattttttaaattgagatatttgttttatcttcaaaattcagtgtatatttttacataatagcacatctcaattcacatgctaaattttcatcagaaatattttatctgtatttaaatttcctaaaatgtacagttgaaaaaaagagattcacatacccaggttgttctagcatgcctaaaaaatcttgtaactggatcaagtatcagtttttaaattagttaaaattaaataaaatttaaaatttagttcctcagtcacactagccatatttcaagtacttgaaggccacaaatggcttgagactaccttgctgaacagaccaaggtcaaacactgagataataatgattcttaaggccatttgaaagttaacagcaagtatgtattactgctatctacagtaagaattacattttatctacaggcaatcataagccatgtctgttatgcagcataggctttccattctctatacatctaggtcatagagtttttccattgataaatctggatgtttatataccaacagtactttcttacaacatattccagtatatagtgtccagcttcacccactttttaaagtggccctgaaacaattttattcatcttattggagtgttgctgtaggggaagagtagaagctaagaagagtttgagttcaacaccattatatccaaatcctgaccttactactggaatgtaagctccttgaaagtggagatcttgtctgtcttgttcacagttgtgttcccagccccagaggtagtctcagggccaatatcaagtatgctctcaaatatttgctgggaaaatttactagctggataaaaggcaagttactttaatctctttaatcttcctttgtccttacaaatgaaagagactaatagtacttaaccttgcagtgttattataaggattaaagttgataaatatatgatcatgagaacaattgctagcacataacggtcactctgaaaatagtagctgatatatcagctgcattgtttgattattgttggctcaattaaaagttggcttttccaaatcctccattaggaagaatttttaaatagccatattgaaaataaagttgtcagaaaaccaatgtaacatatgttgaatttttattaccaaaaagaagttactatccagttgtacagaaaagtagaatgaggttgtgcatcaagaaaaaaattgttcgttctcaacaaaaatttaatcacatgggtagtttttttttttttagctatgggttcatgctgtatttggttgcatcatatttgataaagaagcttccaacttagcatgaaatacctaaagacaattttttttttaagttagtaggcactttttagaatttccaggaacttttaaagatgttgtctccaaaaaaaacaaaaaaatcctgtaaagtatacaatcctacatttttctatagaagagcttagggaagaaatcattcaaagattggaaagacttatgtgtagtattctgtatactaaagggtatcaaatttagttgtcagttgatagcaatttaatttcttgatacatggcatacactggaatcttatgatgaattatttaggggacctgtgccacaaagtctactagaataaacctatcctaaacttaatcctgttagaatttccttcttttgaactctgtttaaaaaaaaaaaaatctttccagaaagtaggaagttataatttctattttctgaaagacaaacaaaaattctaaataggatatttgaaacagacccactgtatcctaaatggaagtgctattaaaaggaaatgctattaaaataagatttcatatattactgataattcataatgaattttaggattccattcaattacatactaaaaattacattttttatagtggcaatgtacttttatcagtattcttatttgacggtcaatttgagttcagtgtaaacaaataggacttagaaaaataatttgtaactcaagatgctgtacctcatcctataattgttgttttgtaatattccttctcaggaatatgggctaaggatatctcaactctgtcagatttgttgataagaatttaatagtaaggagttcttatagcctataaaaagcatgaattatgagatcaaatgtgggagttactatatgattatctgcattacaaaatgaaagcaaatgctttatttattccaacaaaaaaagacctatataaattagtttaagctaacatttagacatttactattacatatatggtatttgcaaccaaatcactgagtttgttgttgtcgttgtttgaggctgttgctctgtcacccaggatggagtgcaagtagctcaatcatagcttactgcagcctaaaaactcctgggctgaagaaatcctctcacctcagccttttaagtagctgaaacattaggtgcacaccaccaggcctggctaattttttattagtgataaggtcttgctatgttgcccaggctggtctcaaactcctggcttcaagcagtcctgcctcagcttcccagagtgctggactacaggcttgagccactgcacccagccccaaatagcttctactcataacctagtgtggcctaaatttatttaaaatgcccgggtaggccaggcacgttggctcacgcctgtaatcccagcacttgggaggccgaggtaggcagatcacttgaggtcaggagttcgagaccaacctggccaatatattgaaaccctgtctcttctaaaaatacagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaatgaacaaatactgcctctgga

SEQ ID NO: 144161 - DNA, 591 bp, Homo sapiens
  Payload ID: 8489
  Gene Symbol: IRAK1BP1
  Gene Name: interleukin-1 receptor-associated kinase 1 binding protein 1
  ENST ID: ENST00000606929
  CDS Start-End: 1-134
aaatagatgatcaccagtcatccagactctcaagttcattaactgtacaacaaaaaatcaaaagtgcaacaatacatgctgcttcaaaagtatttataacttttgagaagttactcaggcgtggtggcgtgtgactgtaatctcagctaccggggaggctgaagcagaagaaacgctcgaacctgggaggcagagcttacagtgagccgagatcgcaccactgcacttcagcctgggtgacaaagtgagactccatctacatacatacatacatacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaatgaacaaatactgcctctgga

SEQ ID NO: 144162 - DNA, 1387 bp, Homo sapiens
  Payload ID: 8489
  Gene Symbol: IRAK1BP1
  Gene Name: interleukin-1 receptor-associated kinase 1 binding protein 1
  ENST ID: ENST00000607739
  CDS Start-End: 792-1370
atgcatatctaagttctagtgcaagagaggactaggagtaaatgctgaagggagtgtttaacccctttaacccattgcagtatgagcaagactactgtaagattcctttaacacagtgcaaccaaaagacagacaccttttctcctttttgcttcacaacagaccacctcagccaccatgacacccagtaggaggtattccacaggaacagcagacgagaacttaccttacatcatgacacatcaaggcatatagttcttgcaatggactaaatgtttgtttccccccaaaatttatagttgaaacctaatcccaagtatgatggtattcggaggaggcttttaggaggtgattgggacatgaggatagggctgtttatagatgagaactccaaggaccagagtgattattggcaggttgcttgcacacggtcacagccaggaagtggcagaattttaactttagggtccatgctcttaaccactacaggatgttgcttctttattctcttgacagtggataattgagattttaggtagggaagatgtcactgatgctattgataccactacttgtatcctttggcacttcacatttgtgtgcatgcaggcccagcttccatctgacaacatttgtaaattctttgcctgaaagtgaaagctttccctggctgccggaatccactctctgcaaatggggccagagtgtaatgccagggaattaaagtcctctcccccagccccagcagccttcatctgaaggctaatgtagaactagaatgactgagggaaatgaatggaaagagaccccagcatcttcaccccttggggtcggataattctgaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgacggcaagcctgtcttgttgctgttgagaatgcgtggcgcaaagctcaagaagtctgtaaccttgttggccaaaccttaggaaaacctttactaatcaaagaagaagaaacaaaagaatgggaaggccaaatagatgatcaccagtcatccagactctcaagttcattaactgtacaacaaaaaatcaaaagtgcaacaatacatgctgcttcaaaagtatttataacttttgagcaactcctggaatccttcttcaacatcccaaccaacaattactcccagatagccatgtcacctgtgaattatcatgaatcccacatcaaatgaacaaatactgcctctgg

SEQ ID NO: 144163 - DNA, 1634 bp, Homo sapiens
  Payload ID: 8489
  Gene Symbol: IRAK1BP1
  Gene Name: interleukin-1 receptor-associated kinase 1 binding protein 1
  ENST ID: ENST00000606868
  CDS Start-End: 1-534
gtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcgagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcgcaactcctggaatccttcttcaacatcccaaccaacaattactcccagatagccatgtcacctgtgaattatcatgaatcccacatcaaatgaacaaatactgcctctggactctgaataattattcctagtgccatgactaaaactggattgaccaggactggaaagagtattcaaagctttggaatgtttcacagaattctctagtactaaaacatacaaacaaaatttaaaaattaagagttattgaacctaaagataagaaaaaaggttaacctgaattatttgaattagccaagacaacaaaacctgaaggatgcttaaagctttcttaggaaagctactttctaataggaaaaaggcgtatccaactagaaactcttaatagtttcagcccttttagaagctgtcccatcatttcaaaatttcgaaggcaagtcttggcaaattgctagctagtgtgggtactgtgatttaaattcaggtagtttagatcagagttgccatttttaagcattagtctataatgacctaaacctcaatttaattcttcttattaaaaacttttttttaaaataggaaattaataaagaaggcaaaaacaacagtgtctgctaggaattactaaaactcagtatattgcatttggcaaagtaaaagcttaaattaagaaaatcatcatatacatttcaatttagaaagtgagtcttacttgttttccctggtattgcagatgcattagcttttgtaataaaagtctttgcagctgaagaagtagatggttgctcagtgacaactggatctacaaccactcggttgcttctggttcgaaccacagaactagattctgttttaccgtttatctgagcagcattgtgtcttggcggtattgatcgtgtaggtgtagagaatgcagaggtagagctttctgattttagctggggttttaagatcctttttttcctttcagggctgtaaataaaatagtattgtcagtcactcttatagctctatgtgaacgaataaaacagtttataatatttttggattcaatatttgtactattatgaaatatgttaaaatatgagatttatagtggatttcatatgattgtgagcctttgaaagtgaatatttagtgaaggatcgctgt

SEQ ID NO: 144164 - DNA, 3483 bp, Homo sapiens
  Payload ID: 8490
  Gene Symbol: IRAK2
  Gene Name: interleukin-1 receptor-associated kinase 2
  Uniprot ID: O43187
  ENST ID: ENST00000256458
  CDS Start-End: 91-1968
ttccccgccggtccgcccctggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgatattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacagaaacttcgtggcaaattgagatcaatgaggccaaaaggaaactgatggagaatattctgctctacaaagaggaaaaagtggacagcattgagctctttggcccctgatgaccggaacacagctgaggacccttgtcctcagttggaaagatgagcatcagatcaagaaaaaggtctgaggcagaatccaagatctgccaggaaacacacaacaaaacatctgctgtcctgggtgggagggaaacttcatttcactggaatgagttgggagagaaaggccctcagcttttagagacacaaaaatccatgaagtctcttcctttctgggctttgttagtcagagcaggggatcagaggagactgaagcagaaaccctgcacacgggcccaggatgtggctgattttgtggttccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtc

SEQ ID NO: 144165 - DNA, 8663 bp, Homo sapiens
  Payload ID: 8491
  Gene Symbol: IRAK3
  Gene Name: interleukin-1 receptor-associated kinase 3
  Uniprot ID: Q9Y616
  ENST ID: ENST00000261233
  CDS Start-End: 422-2212
gctttcaaaaataaacttttgtaagaagtaatgacaccgctagccgtccacaccaggagaccgcctagccgtggggcacggtgggctcctgggagctctgagctctgggctttctccagttcgcactctgcttgtctcggcagctccgtccccaccgcagaggtgtgaaggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctggcagagagactttcaagcagctggctggatgttcgtcatattgaaaagtatgtagaccaaggtaaaagtggaacaagagaattactttggtcctgggcacagaaaaacaagaccatcggtgaccttttacaggtcctccaggagatgggacatcgtcgagctattcatttaattacaaactatggagcagtgttgagtccttcagagaagagttatcaggaaggtggatttccaaatatattattcaaggaaacagccaatgtcaccgtggataatgttcttattcctgaacataatgaaaaaggaatactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggagaaaaaaatgcagtgtaagaagcattggaagaggtttttatctgagcttgaagttttactactgtttcatcacccaaacatactagagttggctgcatattttacagagactgagaagttctgtctgatttatccatacatgagaaatggaacactttttgacagattgcagtgtgtaggtgacacggccccactcccttggcacattcgaatcggtatattaataggaatatccaaagccattcactacctgcacaacgttcaaccatgctcggtcatctgtggcagtatatcaagtgcaaacatccttttggatgatcagtttcaacccaaactaactgattttgccatggcacacttccggtcccacctagaacatcagagttgtaccataaatatgaccagcagcagcagtaaacatctgtggtacatgccagaagagtacatcagacaggggaaactttccattaaaacagatgtctacagctttggaattgtaataatggaagttctaacaggatgtagagtagtgttagatgatccaaaacatatccagctgcgggatctccttagagaattgatggagaagagaggcctggattcatgtctctcatttctagataagaaagtgcctccctgccctcggaatttctctgccaagctcttctgtttggcaggccggtgtgctgcaacgcgggcaaagttaagaccatcaatggatgaagttttaaatactcttgaaagtactcaagccagcttgtattttgctgaagatcctcccacatcactaaagtccttcaggtgtccttctcctctattcctggagaatgtaccaagtattccagtggaagatgatgaaagccagaataacaatttactaccttctgatgaaggcctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcaggccagtggagagcagctgttcctccaaattttcctgggatgaatatgaacagtacaaaaaagaataaattctaccagaagataaagaaaaaagcaagtattgcataggcacctgagcataggtatgaccttgggaagacattggctccataagcaatgccaagagaatgatcaatagtgagtttgggtgatgcagataaacaatctggataattccatttcttttttcccaaaccctcaaacagagtgccttaaaaaattgttttatcaggataattgtctcatgaccaaatccacgctcaattagagccattcaaaattccttaagatcatgggttctgacttcagccaaacaaaacaatcaaaacctaccaaaaagggactggattgtaatgtcctctccatcatcctcagtgtgagtcctcagagcctccatctgccaagaacattcagttggattccatcgtttggtttagcttgcttgcacgggttgtaggaaatgtctaatttgtaaatgttaatagatacctttggaaagaatcaccttgttattctgattgacccctcttgttttttggttaatccctgactagcctgcttgtctgaaaatgagccaggttcacccttagctacggcatgctctgggttgaaaggggatttcttcccaagatctatcctaaactcttaggacagtttatcctgtattgactattattacagctttttaaaaacagacttagtgacctattatatcttaaggagactatgtgaaatgtccatcaagtaatttttattcctgagaaaatggctggtcaagggcctaggtcagctttttgtttaatctacacctttcaactctgggccttcattcctgctgtttcttggatctccctcttttgaaatcctaccaatcatcagagctctacaaaacagccacctcctggaagcttccctaatctctacaaccagaagtactccctttatcagtatttccacagcaatttctttgtatttctattttatatttatcactttctgaattatatcaaagctgcttgtcttatctctttttttttttgagacggagtctcgctctgtcatccaggctggagtgcagtggcacaatctcggctcaccgcaaggtctgcctcccgggttcacgccattctcctgcctcagcctcccgagtaaaggtgggactacaggcgcccgccactacgcccggctaattttttgtatttttagtagagacggggtttcaccatgttaggcaggatggtctcgatctcctgacctcatgatccgcctgcctggcctcccaaagtgctgggattacaggcgtgagccaccgcgcccagccttcatctcttttactaggttgtaaactccctatattagttttctattgtttttgtaacacattatcacaaatttagtgacttaaagtaacataaattaattattttgcagttctggaggtcagaattccttagcattctttctggaggctgttggggagaactcactgccttgccttttccagcttctagaggccacctgccttctttggctcatggcctcttcctccgtcttcaaagccagcaacgtgacatttcagatctccctctctctgtctgtctcaccgcatctcttcactaccctcttcctctcattctggcccttctgcatgtcttttataaagacctttgtgatttcactgggcccactcatataagccaggaaaatctctgtgtctcagatccttaatttaattacacctgcaaagtccgttttctcgtgtaaagtaacatattcacaggtttctggaattgggacgtggacatcttcgggggaccattactctgtctgtcatactccctgagtgtgtaagggccatctcttcagagcctaatgtgtcatcctacacagagcaggtgtttccttataaattaagttgaattaaattacccctatgaagccacataatcaataattcagctataataaacattgccgaataaattaacaaagggaggataatgactccttatgatgatggatagaaacactgaagaaaaccattttcagaggatttactgaattttcctctccaaggagcttgtaatagaagggtaaacctctagtttcttgtccagcagaggaataggctcatgtcttttgttttattttatttttttggtgagtcagtatggttgggttaatcatattcacattagattccatgttgaagaacaactaatcaaagaagaaaatcatcaggaatcagggtgagattaacagaccaaggtcagaaacatggagttacaattttccaaaaaagcacgaagtgagattaaaaccacagtaagtcttagtctgactgacaggctttatacaggccctcggtaagcagttgggagaacccatgcccaccactgctctgtacggtatctggctgctcagagctctctgattcacaaaagagatcatcaagaattgactctgtgttaaactgtttttcacttagaatatggacccccaccaatacattcaatgaagggtcattaaggaagctctgattaacaccaggcccatgcagttactccgcacatataatctgtgggtattatgttgatttgaacttgcttagctgacttaaagcagggtttctcaaactgtagtatgcatcagaatgacttggaaagctggttaaaaacgcagattgctgggtccacccagcttctgatgcaataggtctggggttagaaattttgctttctaatgagttcccaggtgatgctgatgccaatgatgtgaagcccgctcttcacatccgtgaaaatcgctgccttaaggtgctcttaaattgttatagattggtagatcctacctttccatcactggtatgttttttgagaaaaggatcctttcttttcattctgttatattcatcctattacataggatgttggttagcacagagtgggagctctagaaagattgttgaccaatcatcttattgactagaccatctttctagagtataactattttggacacctcaaagatgaagtcagataagctggcagtgacctgattaacgttgtggtaagcagatgccactgtggctgggaagtaccaaatcttctgttgagtgattcagtcttcctgactagatttgccttctagtgggtgtattaataagcgttagttgatatgaattaaatgttgcaactttctatgggtaataagaggatacctttatagtttcatgatgtggagaccaagatacataagaaagcaagaatgagtctccgggtgttccctctgatcagcaaacatgaattcataatttcatttactctcatttttgtaatgcactctgagcaatcctccaggcagatcctatttactaagcttcaggcttttgtcccattttataatgcccaaacacatggagaaaacattttgttgtttttaaaaacaggtatgggatttctgatataatcaattttattgacttcttgggagttgtaatgatctgtgactcactgcataatattgtagttttatagggtggcacatcaccctgtgtaaaacaactttaatgacctgaggactgatgagtacaggaagtgaggtttatcatgagtagcatttattaagcatctgctagaatcaaagcactgcattagctactaaggtacaaagtaagacacagtttaataaggaagacagggcatctacccaagtcaacagttcagtgacatctgttatttgaaccacacaccaatgcaaccgaagtaaatgctgaaagggtgagaagaaggaatagattactatgcatttttgagaggatgaagaaggcttcttggagaaggtttctgaaaagagatacggaattaagagaaatagaaaagagcactgacgaagcactcaggatggctattcaaggaattggggatccacagcagctgtgcacaaccatccctaatgccagaaaaatggggtaagggtgaagggaactgggtctagagctttgcatgtttttttctggttaacccttagagtcaccctgaaggtgtggatcccatcttataataaggtgaggacactgagtcaggaaactaacttgctaaaatcaagtcctcccagtcctcccatcaggtccttccagatctggaggagccaggatttgaactcacatttgtctgacttcaaaatccatgctttttcttgtgttccaaattgcacaatggagtcactgccagttcaagctcctatgaaaagggatggatgtgaaaagtcatttgttgattccacagatttttagtaggtaccatgtctcctgcctttatcactatcctactcctctgctacaacttctctgctacaggcacccactgcagttacttgatatgagttaaatgaatccatccatccaaacttccattcattgaataaatacttagcaatggcttcctttgtatcaggcactattctaggagctggggctacagtgcagatggaaaccagcaaagctcactgccctcatggagcttatatgtaagtgaataaatctcagggtggttctcctgtcataggtcctggctcctctgccagctcttccaaatgggttcagagaggttttctccttgtcctgttgtgtaactgataatcccatggtggacctcactttgctattcatatgcactaagtagtttatggtgtgctttgtggctggcaattgtgacagattctattcttctattggtatgtggtttctttggggcatttgtttggatactgatggcatcttccgggggtctgaggcacctacacaaacctcaggtcactatcacgtgatactggagttgcctgttaaattatatttcttcttccacaaaactgcaggttccctgagggaaaggtctatgtcctgctcatttttggatccctaatggctggcacagtacctggtgcataatatggttcaacaaatatttgtaaaatgaatgaatcaaatagtccttcaaagcatcttcagaatcaagattgtcatctagattgcacccgaagtttatctttctagtattcagaatataatcaatcattgcttaaattattccatttcatcattcttgaataaaagctactaattttaaatactaatatctgagatatcttcgaaaagaagattagtcgttgtatgtgttgcttataaattttctctatggtggaaaatattcccaaaccatgtctaagcaatgaaaaaccagtgttctggcaggaaataaactgatgtttgttgtgttttgtatctgtcttcccgttccaaatcatttatatatacttgatggtctgtgggcttgacttgcaagtattttcctgggagacatttttattcaaaagacctgtattgcctgccaaaccttcatttaagagactcattatggatgtcatctgcatcattgcaaacttttctggtcgtctctataaatagcaagataatatttacagagttttacattggctcttgaattttaaaatattcttatagacaaacattaattggaatggggggtaaggaggtaggaatggcttacttgcggaaatgcaggctcattgttgtgtctagtaggtgctaggtgcattcacacatctcttaagctttaaacaacctattgagccggtttccatttccttgatctattagatttaaaaaaatgaagcataaaggagttggctcttgccctaagtcatactactgatggaatgagaatacaaaccaaaaacactttattcaagtccaggaaatatctgccttgaaaaagaataacttaaaaattaaaagtgtcctctatttgaacatgaaaacagctaataaagatgtgttattttattttattattattaattttgtcctcccatattggcaaagataaagcaattgacaaaaatggaattcttgttcaatactggcaggagtgaaaattggtagaacctttctagaaggcaatttggcaacatgtatgaaaacctaaatgttgatacacctttacccagcagtttgtttaggaatttatcctaatgaataaaagttgtccaagtcttcaaacatgagcccaaaggtatatttcatgatgtttatgatattaaaacattggaaacaactgaaacatccttcagtaaaagatggattaaataaattccatgcagttgtcatttaaaaatatttagatatatgtttattgctatggatatatgttcccaaaatattattgaatcaaaaagtagactacaggatatatgttgaatatgagctcatttataacattgaatattttaagataatgtatgtttcatagagagatcttcaccaaatgttaaggatttttttttctgggctgtggtatttgggtgatctttacattcttcagactcatgtgtgtttgaaactttttataatgaacatatatcatttttattagaaaagaataaagtttttgaaaaaaaaaa

SEQ ID NO: 144166 - DNA, 1853 bp, Homo sapiens
  Payload ID: 8491
  Gene Symbol: IRAK3
  Gene Name: interleukin-1 receptor-associated kinase 3
  Uniprot ID: Q9Y616
  ENST ID: ENST00000457197
  CDS Start-End: 44-1651
gacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggagcagtgttgagtccttcagagaagagttatcaggaaggtggatttccaaatatattattcaaggaaacagccaatgtcaccgtggataatgttcttattcctgaacataatgaaaaaggaatactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggagaaaaaaatgcagtgtaagaagcattggaagaggtttttatctgagcttgaagttttactactgtttcatcacccaaacatactagagttggctgcatattttacagagactgagaagttctgtctgatttatccatacatgagaaatggaacactttttgacagattgcagtgtgtaggtgacacggccccactcccttggcacattcgaatcggtatattaataggaatatccaaagccattcactacctgcacaacgttcaaccatgctcggtcatctgtggcagtatatcaagtgcaaacatccttttggatgatcagtttcaacccaaactaactgattttgccatggcacacttccggtcccacctagaacatcagagttgtaccataaatatgaccagcagcagcagtaaacatctgtggtacatgccagaagagtacatcagacaggggaaactttccattaaaacagatgtctacagctttggaattgtaataatggaagttctaacaggatgtagagtagtgttagatgatccaaaacatatccagctgcgggatctccttagagaattgatggagaagagaggcctggattcatgtctctcatttctagataagaaagtgcctccctgccctcggaatttctctgccaagctcttctgtttggcaggccggtgtgctgcaacgcgggcaaagttaagaccatcaatggatgaagttttaaatactcttgaaagtactcaagccagcttgtattttgctgaagatcctcccacatcactaaagtccttcaggtgtccttctcctctattcctggagaatgtaccaagtattccagtggaagatgatgaaagccagaataacaatttactaccttctgatgaaggcctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcaggccagtggagagcagctgttcctccaaattttcctgggatgaatatgaacagtacaaaaaagaataaattctaccagaagataaagaaaaaagcaagtattgcataggcacctgagcataggtatgaccttgggaagacattggctccataagcaatgccaagagaatgatcaatagtgagtttgggtgatgcagataaacaatctggataattccatttcttttttcccaaaccctcaaacagagtgccttaaaaaattgttttatca

SEQ ID NO: 144167 - DNA, 1579 bp, Homo sapiens
  Payload ID: 8491
  Gene Symbol: IRAK3
  Gene Name: interleukin-1 receptor-associated kinase 3
  ENST ID: ENST00000545837
  CDS Start-End: 106-387
ctgctgccgtcgtggaagcaggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctggtgtctaaaaacaagctttgtgagaatggagtcttaattttgcaggggttttggcatgtggttgtatgcaaatacaaagattccaaatacggatgtgttgcattatttgaaaaaaccccttcagagacatatttgcatatggagacgtgatttctgcaactgaaaacagtcagtcctgcactctcaaaacagccttcaaggacttttgagcatctgatttctgaacttcttaggttgactttttggcttatgtgactccaatacgactttcaacaaagatttgtgttccaaaaaatggttttaaacaatgcttaactaacagcatgtttttcttaatttgtattttcagtttagaatgcttttaactttatcaacataattagtcattgagaacttttctctgtatttttatttgatatgtactgcgagtaaacaaagtcctatattctgaaaggggacacgtaagggagagttgaagaaaatgataaatattgaagaatgtaattaacatgttgagagtttgcattcctgttgtatcagattggagctattttatagaattggatctaaatgaagtatacattttatggatgctaaaaatactctttagcaatgtttctattcagaatgcatcatcattagagaaaagctattaaggttgcagtgtgaatcaccagttggaaaaagagaaaacatatttcatttccagtccggaagcaatccatgcatgcaggcagtattcattttaacagtctggatcagttttttaccatgaacttctgctattagaaaaaatgcctttgtctaatctagctttccttagatgtgatgcaaactcagaactatatgccccggtcaatgttagagaccctaaaaccccagctcatttggcatctgttcattcatattccagctgaatctcagaaatgtgcttaagggaaagcatctgatattagcagtttctcagccaagtcacaggacgggacatcccagagtcatggcctgctgcacttttaaaagggaaattcaggaatcaaaaaaaaaacaaacagagaatggaatttatggaaagtatggaatgaaaagctgacattccctgggacttgaaatgttaactctggatttccttaatagctataaactgtgcctttcctactgtggcaattgttgtgagctagaacatgtttatacctttttatgtataaatattttatctgagactcctgctactattgccacccgatgcatcttccaaaaggtaaagcttccatctttgcatcaccttctcagaaatctgaattggtcccattgctttcagaatgaagttaagttcatatgctaa

SEQ ID NO: 144168 - DNA, 4147 bp, Homo sapiens
  Payload ID: 8492
  Gene Symbol: IRAK4
  Gene Name: interleukin-1 receptor-associated kinase 4
  Uniprot ID: Q9NWZ3
  ENST ID: ENST00000431837
  CDS Start-End: 309-1319
cccgccccttcgcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaagtttgtggtaatttattattcagtaatagaaaacaaatacagatactctcccatgatgtttttcccatgatgatttcccatgatatttacaggttttgcccacatttgaggggtatgtggaaattatacagagcatgtacagcgggaggcttatagtgtacgtactgaaatgtggggttggagccccaacacagagaccccagcaggacactgcctagtagagctatgggaagggtgctgccaccctccagacttgagaattgtagagccaccagcagcttgcactctgagcttggaaaagccacaggcactcaacttcaaccatgagggaagccacgcaccctgcaaagccacaggagtggagctgcccacggcctcgagggcccaccccttgcaccagtgtgccaggatgtgggacatggaatcaaggaatatgttagggcttttttttttttttttttgagacggagtcttgctctgttgcccaggctggagtgcagtggcacgatctcggctcactgcaagctctgcctcccaggttcacgccattcccctgcctcagcctccccagtagctgggactacaggtgcccgccaccatgcccagctaattttttttgtatttttagtagagatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactgtt

SEQ ID NO: 144169 - DNA, 1381 bp, Homo sapiens
  Payload ID: 8492
  Gene Symbol: IRAK4
  Gene Name: interleukin-1 receptor-associated kinase 4
  ENST ID: ENST00000448290
  CDS Start-End: 1-657
atgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaa

SEQ ID NO: 144170 - DNA, 1409 bp, Homo sapiens
  Payload ID: 8492
  Gene Symbol: IRAK4
  Gene Name: interleukin-1 receptor-associated kinase 4
  Uniprot ID: Q9NWZ3
  ENST ID: ENST00000440781
  CDS Start-End: 139-1149
cccgccccttcgcggcgcttcctagttcggctggttcttctgtcgccggcttcagcagcccgcgcccgggcagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtt

SEQ ID NO: 144171 - DNA, 1684 bp, Homo sapiens
  Payload ID: 8492
  Gene Symbol: IRAK4
  Gene Name: interleukin-1 receptor-associated kinase 4
  Uniprot ID: Q9NWZ3
  ENST ID: ENST00000551736
  CDS Start-End: 114-1496
cttcctagttcggctggttcttctgtcgccggcttcagcagcccgcgcccgggcaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccct

SEQ ID NO: 144172 - DNA, 547 bp, Homo sapiens
  Payload ID: 8492
  Gene Symbol: IRAK4
  Gene Name: interleukin-1 receptor-associated kinase 4
  ENST ID: ENST00000550616
  CDS Start-End: 280-547
ccttcgcggcgcttcctagttcggctggttcttctgtcgccggcttcagcagcccgcgcccgggcaggggcctggagcagtatctagcacaaagtagacactcagtaaatatttgctggattttcttcatatacatcaaccaaaacaacatgctgcagtgggttgagtgcagaagcagatacaagaattcagctctcttctattaagttaaatattgaagagattagcaaaactttaaaacaatgttgttcttctgtttttgaggaaaaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatcc

SEQ ID NO: 144173 - DNA, 1000 bp, Homo sapiens
  Payload ID: 8492
  Gene Symbol: IRAK4
  Gene Name: interleukin-1 receptor-associated kinase 4
  ENST ID: ENST00000552309
  CDS Start-End: 108-290
agttcggctggttcttctgtcgccggcttcagcagcccgcgcccgggcaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtgatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtg

SEQ ID NO: 144174 - DNA, 1703 bp, Homo sapiens
  Payload ID: 8492
  Gene Symbol: IRAK4
  Gene Name: interleukin-1 receptor-associated kinase 4
  ENST ID: ENST00000547101
  CDS Start-End: 66-230
cttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgatgtagcaagaaggccctaaccagatgcagcctctcgatcttggacttcccagcctccagaaccgagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccct

SEQ ID NO: 144175 - DNA, 1348 bp, Homo sapiens
  Payload ID: 8492
  Gene Symbol: IRAK4
  Gene Name: interleukin-1 receptor-associated kinase 4
  ENST ID: ENST00000550615
  CDS Start-End: 77-259
ccttcgcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatata

SEQ ID NO: 144176 - DNA, 1757 bp, Homo sapiens
  Payload ID: 8492
  Gene Symbol: IRAK4
  Gene Name: interleukin-1 receptor-associated kinase 4
  ENST ID: ENST00000547521
  CDS Start-End: 700-882
cttcgcggcgcttcctagttcggctggttcttctgtcgccggcttcagcagcccgcgcccgggcaggtaaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggataaaagcaaaccctgtccaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaag

SEQ ID NO: 144177 - DNA, 1751 bp, Homo sapiens
  Payload ID: 8492
  Gene Symbol: IRAK4
  Gene Name: interleukin-1 receptor-associated kinase 4
  ENST ID: ENST00000550386
  CDS Start-End: 114-278
cttcctagttcggctggttcttctgtcgccggcttcagcagcccgcgcccgggcaggggcctggagcagtatctagcacaaagtagacactcagtaaatatttggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgatgtagcaagaaggccctaaccagatgcagcctctcgatcttggacttcccagcctccagaaccgagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccct

SEQ ID NO: 144178 - DNA, 563 bp, Homo sapiens
  Payload ID: 8492
  Gene Symbol: IRAK4
  Gene Name: interleukin-1 receptor-associated kinase 4
  ENST ID: ENST00000550361
  CDS Start-End: 175-357
aatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaata

SEQ ID NO: 144179 - DNA, 4280 bp, Homo sapiens
  Payload ID: 8492
  Gene Symbol: IRAK4
  Gene Name: interleukin-1 receptor-associated kinase 4
  Uniprot ID: Q9NWZ3
  ENST ID: ENST00000613694
  CDS Start-End: 72-1454
gcggcgcttcctagttcggctggttcttctgtcgccggcttcagcagcccgcgcccgggcaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcaatggttgacattactactgaagaactgaaacagcagtttgatcaagaaataaaagtaatggcaaagtgtcaacatgaaaacttagtagaactacttggtttctcaagtgatggagatgacctctgcttagtatatgtttacatgcctaatggttcattgctagacagactctcttgcttggatggtactccaccactttcttggcacatgagatgcaagattgctcagggtgcagctaatggcatcaattttctacatgaaaatcatcatattcatagagatattaaaagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggttttactagaaataataactggacttccagctgtggatgaacaccgtgaacctcagttattgctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaagtttgtggtaatttattattcagtaatagaaaacaaatacagatactctcccatgatgtttttcccatgatgatttcccatgatatttacaggttttgcccacatttgaggggtatgtggaaattatacagagcatgtacagcgggaggcttatagtgtacgtactgaaatgtggggttggagccccaacacagagaccccagcaggacactgcctagtagagctatgggaagggtgctgccaccctccagacttgagaattgtagagccaccagcagcttgcactctgagcttggaaaagccacaggcactcaacttcaaccatgagggaagccacgcaccctgcaaagccacaggagtggagctgcccacggcctcgagggcccaccccttgcaccagtgtgccaggatgtgggacatggaatcaaggaatatgttagggcttttttttttttttttttgagacggagtcttgctctgttgcccaggctggagtgcagtggcacgatctcggctcactgcaagctctgcctcccaggttcacgccattcccctgcctcagcctccccagtagctgggactacaggtgcccgccaccatgcccagctaattttttttgtatttttagtagagatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactg

SEQ ID NO: 144180 - DNA, 2686 bp, Homo sapiens
  Payload ID: 8493
  Gene Symbol: IFFO1
  Gene Name: intermediate filament family orphan 1
  Uniprot ID: Q0D2I5
  ENST ID: ENST00000336604
  CDS Start-End: 43-1731
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgca

SEQ ID NO: 144181 - DNA, 2680 bp, Homo sapiens
  Payload ID: 8493
  Gene Symbol: IFFO1
  Gene Name: intermediate filament family orphan 1
  Uniprot ID: Q0D2I5
  ENST ID: ENST00000356896
  CDS Start-End: 45-1736
cctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagta

SEQ ID NO: 144182 - DNA, 2677 bp, Homo sapiens
  Payload ID: 8493
  Gene Symbol: IFFO1
  Gene Name: intermediate filament family orphan 1
  Uniprot ID: Q0D2I5
  ENST ID: ENST00000396840
  CDS Start-End: 43-1722
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgca

SEQ ID NO: 144183 - DNA, 3101 bp, Homo sapiens
  Payload ID: 8493
  Gene Symbol: IFFO1
  Gene Name: intermediate filament family orphan 1
  ENST ID: ENST00000436152
  CDS Start-End: 561-1331
gatgagacatgacaaagctggctctgggaagcatgccctacctaggaccctgccctgtggcccagggtgtcgtccggcccacttgcagtcttaatctctgaattctgggccctggaacaggctgtgtctagttctcatttgccgtactcaccgggcccctttacatactctactttctctttccctctgggtttgagtgctagtaaccccaggctcgtgtgtccactgctgtcatgctgctgtgggacttccggcctctgagccagtctggtcacctctctgtgactcccttagaggaggctctggatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgagatagcctaggactggagcgaggagaggaaaaggccttgttctctgaagtagtggtgccagcttcctgtagcactcaagacgtctgagcgggaagcaaatggttctcgaagcaagcaaggctgtttggaggccctaccctcagtctgaggagaacataccaggtccctccccagcaagaatgtctcaccttgacacaagcccagcttccctcccctctgccccagaccctagaataagacaggacaagt

SEQ ID NO: 144184 - DNA, 2786 bp, Homo sapiens
  Payload ID: 8493
  Gene Symbol: IFFO1
  Gene Name: intermediate filament family orphan 1
  Uniprot ID: Q0D2I5
  ENST ID: ENST00000487279
  CDS Start-End: 43-837
tgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggagatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgca

SEQ ID NO: 144185 - DNA, 2850 bp, Homo sapiens
  Payload ID: 8493
  Gene Symbol: IFFO1
  Gene Name: intermediate filament family orphan 1
  ENST ID: ENST00000465801
  CDS Start-End: 561-1328
gatgagacatgacaaagctggctctgggaagcatgccctacctaggaccctgccctgtggcccagggtgtcgtccggcccacttgcagtcttaatctctgaattctgggccctggaacaggctgtgtctagttctcatttgccgtactcaccgggcccctttacatactctactttctctttccctctgggtttgagtgctagtaaccccaggctcgtgtgtccactgctgtcatgctgctgtgggacttccggcctctgagccagtctggtcacctctctgtgactcccttagaggaggctctggatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgag

SEQ ID NO: 144186 - DNA, 2724 bp, Homo sapiens
  Payload ID: 8493
  Gene Symbol: IFFO1
  Gene Name: intermediate filament family orphan 1
  ENST ID: ENST00000619571
  CDS Start-End: 55-1770
gccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctgtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgc

SEQ ID NO: 144187 - DNA, 2775 bp, Homo sapiens
  Payload ID: 8493
  Gene Symbol: IFFO1
  Gene Name: intermediate filament family orphan 1
  ENST ID: ENST00000615885
  CDS Start-End: 1062-1832
caccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggagatgcttttacagggttaaatgataccacaagaggcagggcagcgggctcgacgagctctgttctggtgcgggcaggaggcgggagcccggatctgtgcgactgaaggtgggaagaggagtacacggtgcggatccagctgcaagaccgtgtaaatgagctccaggaggaagcccaggaggctgatgcctgccaggaggagctggcactgaaggtggaacagttgaaggctgagctggtggtcttcaaggggctcatgagtaacaacctgtcggagctggacaccaagatccaggagaaagccatgaaggtggatatggacatctgccgccgcatcgacatcaccgccaagctctgcgatgtggctcagcagcgcaactgcgaggacatgatccagatgttccagaagaagctggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgagggagtatgattttgaggacgactgtgacagcctgacttgggaggagactgaggagaccctgctgctttgggaggatttctcaggctatgccatggcagctgcagaggcccagggagagcagcaggaagatagcctggagaaggtgattaaagatacggagtccctgttcaaaacccgggagaaggagtatcaggagaccattgaccagatagagctggagttggccacggccaagaacgacatgaaccggcacctgcacgagtacatggagatgtgcagcatgaagcgcggcctggacgtgcagatggagacctgccgccggctcatcacccagtctggagaccgaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagt

SEQ ID NO: 144188 - DNA, 537 bp, Homo sapiens
  Payload ID: 8494
  Gene Symbol: IFFO2
  Gene Name: intermediate filament family orphan 2
  ENST ID: ENST00000355609
  CDS Start-End: 1-267
tgcaatccgaccatcgacctgcagggcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcgga

SEQ ID NO: 144189 - DNA, 6188 bp, Homo sapiens
  Payload ID: 8494
  Gene Symbol: IFFO2
  Gene Name: intermediate filament family orphan 2
  Uniprot ID: Q5TF58
  ENST ID: ENST00000455833
  CDS Start-End: 355-1908
cagaaggggcagtgccggccgagagtcctctgcgtgcggctgccgcggcccctccacagcgtctctgacagcccgggcggtgagacccgcgacccttctggccccgcgcagataccgcggcctccaccgcgtcccgaggagcggccgagtgccctctctcgcctcggcgcccgcatccggggccatccgtcctgccgtctctgcggaggccgcatctggcgcgcatctggaaccgcccggccggccgcgctggagcccgcgcccaccctggcccggccgcgccgggagccctgcccggagctggagccgcacctggagccgcgggcccggggccctgagccgcgcagccggcgcatggtgaactcgctgctgttcggggagatggccttggccttcggctgcccgccgggcggcggcggcgggggctgccctggcgggggcggcggcggcggcggggcagggccgggtccgtcgccggtgacggcggcgctgcgggacgacctgggctccaacatccacctcttgaaggggctcaacgtgcgcttccgctgcttcctggctaaggtgcacgagctggagcggcgcaaccggctgctggagaagcagctggagcagcagcagagcgagcgcgagcggcggctgcgctacaagaccttctcccgcgagcaggccgtgcagaccgggcccgagttgctgcggcccccggcgcccggcggcgggcacggcctcagcagtggcgcggcggccggcgccaacgccaatgccgtggccctgggcggcctgccccccggcggcggctcgcacccgcagcactacggccgcctgcccgggaccatctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgatatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaacaaaacaaacaacaaaagcagcttgccttatatcattgtggaaggcaggacctctcctgggctcctggcttccccctggagctgggagagaggccggggttagggtgatctgtgtggcagcactgactgggtagtgtgggtttggccgaggttggtcatgaggctggggttcccgcaaggcactggcctccctgaccgcttgcttccttccggacctctgggttcagggcgggggcggagggatccttgatttccctgataacttgatgttcttccctccctcgccagccaacaatagaggcttagagatctgtaatttctctgtgagaaagtctgaaggggccaggcctggtctctgctcccttctacccgccttgggttaggactgtccggcagttgcctgcttttggctgctggcaggagagaagcagggtgggctgctggcagtgcaggagctggagtgagggccatcctctttctgctcctcgacacacgcaagccgctctcagcagttccctcgactggccagtcggggtattgatctgagccagcatcccccaagacttgaatggcttgagtgggactgcgttgaagggcactgtgtggcccccttccaaatctcagcttggagccagctgagcaggctttgctttattattattttttaagcctactgcagtgggtctgttgccaattttaattttttattgtcccaggagctccctctagtggtcaaggtagcaaaatgtgcccaaggactagaacttgggtccctctgccttgcctggaggcagaaggagggggctctgggtttgactgggattgtggtccccaggggtccgtggcctttaaggctcttctctcttttctgtttcccccacctgtgttacagtcttaaaaatactgtacataaaagatatatgtagagagagagagagagcgtgagaatgtgttagtgactatgtgtgatgtaatttatcacgatttggtggccttcgtcatgagttttttcctttgttttcttttgctgggggcacctcccacgggtcccctgtggcagtctggctgtgacacttccatagtcagcatctcttgttagccaaacagttccctttgacaggtacttggagggacaatggttttggaagagagacggcccttctctctcctcactcacccttgttctaaaggttacagggttcaaacatacctgattcttgttgttattgttgttgaatttttattttaaccaaaggttatcagagccagttgggcttggacctcagctgctaaaaagattttccgtttcctcgagggcaggaaaacatccaccctcgtgggtctcctccgtccagggccgagggaggcattggacaatgtggtatgggagtttcgtgggcagcgtggaagccggccctgggttgttccccaaggtggtgggagggtgacagatatatctttagacttaagactgtaaggcagcagtgttagcatgggagtaactaaggttactgtggttatcggtgtccggcggtattatttttactttcctccttgtatacataggtcatttgtctttgaggactagggtactctagggagtttgaaaactgcaggagccagaaagagatcctggcctgagagtcccttctggctggcttttaatatctgctctcctcttgggagtgaggacttggggcaggtgggtaggagagggaaagccagagtgtgatgggcctgcctcctgggctggttcctgggtccggcctgcctgcctgcctgcctgcctctccaccacatgcttttttcagttaatgtcagtgggccctgcttgtcccctcaccatgagcccacagcttgccaagaaagaccccaacgctcgctggggcagcaccagtcctagctgggacgaattggtccatcctttgtaaagctgtaaatacttaattttgactttctatttctaagcccagtgtcatattgacactggtattttagaattttctcagatgggctctcctgcgctgccctctgtctcctgtttttgggggttttatacaaacagaggattggggagggataggaagactagcatccttttggctccctggttggttgtgaaatacacacacacacacacacacacacacacacactcgcactcctctgagactccgaacagagaaaaaaattattggcaaatcaacacatttttctttctcgtcttgagaaaatgtcttgaggtccctgaagggccaaatccatcgtggactaactctgtgggtagagctcagatgacctagggagaattaaaccacttaagcttggagtgggaggagagggggtggggtgggggagaatataagatgtaacttaagctaaatgtaatctatttataaagcaagagactctcatctatttttatgaaaggaagggttttttaatctagggtaggcagttgtggtagcccagcattttcctgtggacgagacatggtgcatgttgttgctggattgaatggaacccattcctgtcccccggcctcgtcttctgtcctcacttttggtcatccacacccatgagcagcttcagcagagtgtaggtcccacttcaccccattctcctctcctctgacccctcagctccttggaagtcttggggtggggatctgagggggtgggtgggctgcaggaaattcagaaatgtggtgggtgggggaagggacaaggcgcattagggagggaacaagctgggctctggggataggctctgattaattagttactctgactctggtctgccgagatccatttccaacccagttgcgttgggagagggttgggaggcagcagagcatgggtgacagtgggagcacacgacttccttggagcctgggcctttgcgggtcccaggtggtcaggcagctggagcagaagtggaaatggcttaagatgctcatagcccagccccggctgtgtctactccaggccaagcctgggctgcagtccttgctatgttccccccagggccctggggggagggatcagggtgctgggggtttcctaggacaggggtcttcccccttgagacaccaagctctggctctagaagagctctctcctggagtggggagtctggaggggactgggtgggtgcaggtaaagccagattctctctggaagggaattttctatgaatggatgatttccaggctcagggtgggctgtgtgttagttctgagcaaatccctcaccaagacccttccctcccaagccctcaaagaaatgaggcaaagcccttccctgcaagaccccttgtggatgtttttgcatctacctgatttttagccccacccagggagactttataccccatgatcctgccccaccgttgctgttgtctgccagctgggtctagcatcacagggaagggggggatttatactcatggaaagactactgatcctaccggaaaccaacctgtttactgtactgttgtaaatatcatgccctttatatcctgtatattggcttcttttaaataaagtgaaatgtcttagaactg

SEQ ID NO: 144190 - DNA, 1000 bp, Homo sapiens
  Payload ID: 8494
  Gene Symbol: IFFO2
  Gene Name: intermediate filament family orphan 2
  ENST ID: ENST00000416166
  CDS Start-End: 1-779
tgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgacgtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgc

SEQ ID NO: 144191 - DNA, 3231 bp, Homo sapiens
  Payload ID: 8495
  Gene Symbol: INA
  Gene Name: internexin neuronal intermediate filament protein, alpha
  Uniprot ID: Q16352
  ENST ID: ENST00000369849
  CDS Start-End: 50-1549
cttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggatagcattgggcagctggagaatgatctgaggaacaccaagagtgagatggcacgccaccttcgggaataccaggacttgctcaatgtcaaaatggctcttgacattgagatagcagcttacaggaaactgctggaaggcgaggagacacgttttagcaccagtgggttaagcatttcggggctgaatccacttcccaatccaagttacctgctcccacctagaatcctcagtgctacaacctccaaagtctcatccactgggctatcacttaagaaagaggaggaggaggaggaggcatctaaggtagcctctaagaaaacctcccagataggggaaagttttgaagaaatattagaggagacagtaatatctactaagaaaaccgagaaatcaaatatagaagaaaccaccatttcaagccaaaaaatataattccattgctttgaaaaagttaatgcttaagagggaatgatatgcatttgacttgttaaacagcctattcctgaactataacacctgccaccactataaaatgtcttcaaggcttcagtctcatatttagtattgaatacttacattctctaataagaaaaccaccccttagattgaagtaaactgcagtcctggagcaatcacagatgagttatctaagaatacagctttctgaccttcagctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatccctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttgaaaaatacttttccttacctttaccccatccctgtctttactcctcacacttactgtaagacattagtaacataataaattaaaagtcacacgaatctcaccaacataa

SEQ ID NO: 144192 - DNA, 3209 bp, Homo sapiens
  Payload ID: 8495
  Gene Symbol: INA
  Gene Name: internexin neuronal intermediate filament protein, alpha
  ENST ID: ENST00000616853
  CDS Start-End: 46-1536
tgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcgcttccgctcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggcccgctgcgacagccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaacgccgagcgcgcctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggatagcattgggcagctggagaatgatctgaggaacaccaagagtgagatggcacgccaccttcgggaataccaggacttgctcaatgtcaaaatggctcttgacattgagatagcagcttacaggaaactgctggaaggcgaggagacacgttttagcaccagtgggttaagcatttcggggctgaatccacttcccaatccaagttacctgctcccacctagaatcctcagtgctacaacctccaaagtctcatccactgggctatcacttaagaaagaggaggaggaggaggaggcatctaaggtagcctctaagaaaacctcccagataggggaaagttttgaagaaatattagaggagacagtaatatctactaagaaaaccgagaaatcaaatatagaagaaaccaccatttcaagccaaaaaatataattccattgctttgaaaaagttaatgcttaagagggaatgatatgcatttgacttgttaaacagcctattcctgaactataacacctgccaccactataaaatgtcttcaaggcttcagtctcatatttagtattgaatacttacattctctaataagaaaaccaccccttagattgaagtaaactgcagtcctggagcaatcacagatgagttatctaagaatacagctttctgaccttcagctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatccctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctggtcaatcaacactaccagcgtatatataagaaagacatctttctcttttctaaaagacttccctaacacttaccccatggctgcacagttggtggggtcctgccggagaggaagagacactcagaccagagaaggggtgtgcatgcgcctactcgcttgctagaagtagattctggacagtcagctcttcatctgcccaactgtgtagcatctgcattgcccagtctttcatgtgtgccaaggctgatgcaggatttgttctctgtccagcagtcacttcggccagagctgaagagttgccccgtctctgttccatgtctcctttaagagctctggtgataaggacatgatgcttttactgaactttcttatcctagcacatgcttcaatagttcaaggaacttgaaaaatacttttccttacctttaccccatccctgtctttactcctcacacttactgtaagacattagtaacataataaattaaaagtcacacgaatctca

SEQ ID NO: 144193 - DNA, 3558 bp, Homo sapiens
  Payload ID: 8496
  Gene Symbol: IMPG1
  Gene Name: interphotoreceptor matrix proteoglycan 1
  Uniprot ID: Q17R60
  ENST ID: ENST00000369950
  CDS Start-End: 191-2584
agattattccagaaacagacactgctacatgttcttcataaattaacaccctcataaaggtaaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagatatctccattaacatataccattctgaaactaaagacatagacaatcccccaagaaatgaaacaactgaaagtactgaaaaaatgtacaaaatgtcaactatgagacgaatattcgatttggcaaagcatcgaacaaaaagatccgcatttttcccaacgggggttaaagtctgtccacaggaatccatgaaacagattttagacagtcttcaagcttattatagattgagagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagatgttgccaacgtctcacttgggcctttccctctcactcctgatgacaccctcctcaatgaaattctcgataatacactcaacgacaccaagatgcctacaacagaaagagaaacagaattcgctgtgttggaggagcagagggtggagctcagcgtctctctggtaaaccagaagttcaaggcagagctcgctgactcccagtccccatattaccaggagctagcaggaaagtcccaacttcagatgcaaaagatatttaagaaacttccaggattcaaaaaaatccatgtgttaggatttagaccaaagaaagaaaaagatggctcaagctccacagagatgcaacttacggccatctttaagagacacagtgcagaagcaaaaagccctgcaagtgacctcctgtcttttgattccaacaaaattgaaagtgaggaagtctatcatggaaccatggaggaggacaagcaaccagaaatctatctcacagctacagacctcaaaaggctgatcagcaaagcactagaggaagaacaatctttggatgtggggacaattcagttcactgatgaaattgctggatcactgccagcctttggtcctgacacccaatcagagctgcccacatcttttgctgttataacagaggatgctactttgagtccagaacttcctcctgttgaaccccagcttgagacagtggacggagcagagcatggtctacctgacacttcttggtctccacctgctatggcctctacctccctgtcagaagctccacctttctttatggcatcaagcatcttctctctgactgatcaaggcaccacagatacaatggccactgaccagacaatgctagtaccagggctcaccatccccaccagtgattattctgcaatcagccaactggctctgggaatttcacatccacctgcatcttcagatgacagccgatcaagtgcaggtggcgaagatatggtcagacacctagatgaaatggatctgtctgacactcctgccccatctgaggtaccagagctcagcgaatatgtttctgtcccagatcatttcttggaggataccactcctgtctcagctttacagtatatcaccactagttctatgaccattgcccccaagggccgagagctggtagtgttcttcagtctgcgtgttgctaacatggccttctccaacgacctgttcaacaagagctctctggagtaccgagctctggagcaacaattcacacagctgctggttccatatctacgatccaatcttacaggatttaagcaacttgaaatacttaacttcagaaacgggagtgtgattgtgaatagcaaaatgaagtttgctaagtcagtgccgtataacctcaccaaggctgtgcacggggtcttggaggattttcgttctgctgcagcccaacaactccatctggaaatagacagctactctctcaacattgaaccagctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaattcctgtcttccaccacagatgaacaatgtcttcctataataacttcagaatatttcctcacaccaactttagtgtgtgtatacctagactggcatcaatgtaatccaattcagtccattttttatgtgctgcttaatgaaaatgaatctgtctctatctctttcaaatgttctaatatcagatatatttgctacaaaccttaatttcaataaagtaaaagtgatatactc

SEQ ID NO: 144194 - DNA, 835 bp, Homo sapiens
  Payload ID: 8496
  Gene Symbol: IMPG1
  Gene Name: interphotoreceptor matrix proteoglycan 1
  ENST ID: ENST00000369952
  CDS Start-End: 1-477
gagagacccaacgggacctcagcccagccagcccaggtgaagcctgaattttataggcaagctgagctgaaaccttgcccttggacaggatccaatcaaaggagatgtatcactttctgtccaacacctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactg

SEQ ID NO: 144195 - DNA, 868 bp, Homo sapiens
  Payload ID: 8496
  Gene Symbol: IMPG1
  Gene Name: interphotoreceptor matrix proteoglycan 1
  ENST ID: ENST00000369963
  CDS Start-End: 446-868
agattattccagaaacagacactgctacatgttcttcataaattaacaccctcataaaggtaaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagatatctccattaacatataccattctgaaactaaagacatagacaatcccccaagaaatgaaacaactgaaagtactgaaaaaatgtacaaaatgtcaactatgagacgaatattcgatttggcaaagcatcgaacaaaaagatccgcatttttcccaacgggggttaaagtctgtccacaggaatccatgaaacagattttagacagtcttcaagcttattatagattgagagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagaaaagaataaaggtaaaaccaaaccattcaatatcttacagtttggaaacaaccatcatgaacatttactgcctattttctgccttctttcttctattatatacacatattactga

SEQ ID NO: 144196 - DNA, 3324 bp, Homo sapiens
  Payload ID: 8496
  Gene Symbol: IMPG1
  Gene Name: interphotoreceptor matrix proteoglycan 1
  ENST ID: ENST00000611179
  CDS Start-End: 191-2350
agattattccagaaacagacactgctacatgttcttcataaattaacaccctcataaaggtaaaccaagaaggttatcctcaatcatctggtatcaatatataattatttttcacatttctgttactttttaatgagatttgaggttgttctgtgattgttatcagaattaccaatgcacaaaagccagaatgtatttggaaactagaagagctatttttgttttttggatttttctccaagttcaaggaaccaaagtgtgtcaggaagcagtatgggaagcatatcggatctttctggatcgcatccctgacacaggggaatatcaggactgggtcagcatctgccagcaggagaccttctgcctctttgacattggaaaaaacttcagcaattcccaggagcacctggatcttctccagcagagaataaaacagagaagtttccctgacagaaaagatgaaatatctgcagagaagacattgggagagcctggtgaaaccattgtcatttcaacagatgttgccaacgtctcacttgggcctttccctctcactcctgatgacaccctcctcaatgaaattctcgataatacactcaacgacaccaagatgcctacaacagaaagagaaacagaattcgctgtgttggaggagcagagggtggagctcagcgtctctctggtaaaccagaagttcaaggcagagctcgctgactcccagtccccatattaccaggagctagcaggaaagtcccaacttcagatgcaaaagatatttaagaaacttccaggattcaaaaaaatccatgtgttaggatttagaccaaagaaagaaaaagatggctcaagctccacagagatgcaacttacggccatctttaagagacacagtgcagaagcaaaaagccctgcaagtgacctcctgtcttttgattccaacaaaattgaaagtgaggaagtctatcatggaaccatggaggaggacaagcaaccagaaatctatctcacagctacagacctcaaaaggctgatcagcaaagcactagaggaagaacaatctttggatgtggggacaattcagttcactgatgaaattgctggatcactgccagcctttggtcctgacacccaatcagagctgcccacatcttttgctgttataacagaggatgctactttgagtccagaacttcctcctgttgaaccccagcttgagacagtggacggagcagagcatggtctacctgacacttcttggtctccacctgctatggcctctacctccctgtcagaagctccacctttctttatggcatcaagcatcttctctctgactgatcaaggcaccacagatacaatggccactgaccagacaatgctagtaccagggctcaccatccccaccagtgattattctgcaatcagccaactggctctgggaatttcacatccacctgcatcttcagatgacagccgatcaagtgcaggtggcgaagatatggtcagacacctagatgaaatggatctgtctgacactcctgccccatctgaggtaccagagctcagcgaatatgtttctgtcccagatcatttcttggaggataccactcctgtctcagctttacagtatatcaccactagttctatgaccattgcccccaagggccgagagctggtagtgttcttcagtctgcgtgttgctaacatggccttctccaacgacctgttcaacaagagctctctggagtaccgagctctggagcaacaattcacacagctgctggttccatatctacgatccaatcttacaggatttaagcaacttgaaatacttaacttcagaaacgggagtgtgattgtgaatagcaaaatgaagtttgctaagtcagtgccgtataacctcaccaaggctgtgcacggggtcttggaggattttcgttctgctgcagcccaacaactccatctggaaatagacagctactctctcaacattgaaccagctgatcaagcagatccctgcaagttcctggcctgcggcgaatttgcccaatgtgtaaagaacgaacggactgaggaagcggagtgtcgctgcaaaccaggatatgacagccaggggagcctggacggtctggaaccaggcctctgtggccctggcacaaaggaatgcgaggtcctccagggaaagggagctccatgcaggttgccagatcactctgaaaatcaagcatacaaaactagtgttaaaaagttccaaaatcaacaaaataacaaggtaatcagtaaaagaaattctgaattactgaccgtagaatatgaagaatttaaccatcaagattgggaaggaaattaaaaactgaaaatgtacaattatcatttaggctatctcaagagagatgatttgccttctcaaggaaaatggagacaggcatattcatgggtcatcaaaatccagacatacagtcaacactgagaatcagcacacaccatatttcaaatatagaagagtcatgtacttggcaaccagtaaattctgaagaaaaagacacttacttattattaaaaccccaaatgcaatcagcgaaacatatttttactattcttggatgatagtcaaaatgatcataagccaggtttgcttccaccttccctgaaaattttactcacagatcatttgcaacaagcatagcttacttattgtttagggactgaacaatttattgggaagcaaactctttatatgctagaaagtacatttaaaagatgactacttacgcagggagatgcaggtctctctaaacgcatgaatgtatgtagtgtgtaggcactgtagtgagtgtatatatgctccacactacgtctgataaacacaaacctcagtattcagttattaggcacactagttttatacgcaactactgcttacatagtagactgttttgttgccaataatctttgaattgttctttaaaagaaactgaggttcagatacacataccatggaaaaatcttacttttcttgttactacacaaagctattttaaagaagatgctatgttgggagaagggcgaagttgtactatatgacataatcaattcctgtcttccaccacagatgaacaatgtcttcctataataacttcagaatatttcctcacaccaactttagtgtgtgtatacctagactggcatcaatgtaatccaattcagtccattttttatgtgctgcttaatgaaaatgaatctgtctctatctctttcaaatgttctaatatcagatatatttgctacaaaccttaatttcaataaagtaaaagtgatatactc

SEQ ID NO: 144197 - DNA, 8337 bp, Homo sapiens
  Payload ID: 8497
  Gene Symbol: IMPG2
  Gene Name: interphotoreceptor matrix proteoglycan 2
  Uniprot ID: Q9BZV3
  ENST ID: ENST00000193391
  CDS Start-End: 189-3914
gctactttgaaaggacaaccatttttctttccgctaatttataatggttttgaagtggttgttcattctcaaacatagacttttaaatgttaggtctttcctataactctttgttattggaagtttcaaggatttggacactcaattaaggattctgtcctctcctcattcctttggttttggcccaaatgattatgtttcctctttttgggaagatttctctgggtattttgatatttgtcctgatagaaggagactttccatcattaacagcacaaacctacttatctatagaggagatccaagaacccaagagtgcagtttcttttctcctgcctgaagaatcaacagacctttctctagctaccaaaaagaaacagcctctggaccgcagagaaactgaaagacagtggttaatcagaaggcggagatctattctgtttcctaatggagtgaaaatctgcccagatgaaagtgttgcagaggctgtggcaaatcatgtgaagtattttaaagtccgagtgtgtcaggaagctgtctgggaagccttcaggactttttgggatcgacttcctgggcgtgaggaatatcattactggatgaatttgtgtgaggatggagtcacaagtatatttgaaatgggcacaaattttagtgaatctgtggaacatagaagcttaatcatgaagaaactgacttatgcaaaggaaactgtaagcagctctgaactgtcttctccagttcctgttggtgatacttcaacattgggagacactactctcagtgttccacatccagaggtggacgcctatgaaggtgcctcagagagcagcttggaaaggccagaggagagtattagcaatgaaattgagaatgtgatagaagaagccacaaaaccagcaggtgaacagattgcagaattcagtatccaccttttggggaagcagtacagggaagaactacaggattcctccagctttcaccaccagcaccttgaagaagaatttatttcagaggttgaaaatgcatttactgggttaccaggctacaaggaaattcgtgtacttgaatttaggtcccccaaggaaaatgacagtggcgtagatgtttactatgcagttaccttcaatggtgaggccatcagcaataccacctgggacctcattagccttcactccaacaaggtggaaaaccatggccttgtggaactggatgataaacccactgttgtttatacaatcagtaacttcagagattatattgctgagacattgcagcagaattttttgctggggaactcttccttgaatccagatcctgattccctgcagcttatcaatgtgagaggagttttgcgtcaccaaactgaagatctagtttggaacacccaaagttcaagtcttcaggcaacgccgtcatctattctggataatacctttcaagctgcatggccctcagcagatgaatccatcaccagcagtattccaccacttgatttcagctctggtcctccctcagccactggcagggaactctggtcagaaagtcctttgggtgatttagtgtctacacacaaattagcctttccctcgaagatgggcctcagctcttccccagaggttttagaggttagcagcttgactcttcattctgtcaccccggcagtgcttcagactggcttgcctgtggcttctgaggaaaggacttctggatctcacttggtagaagatggattagccaatgttgaagagtcagaagattttctttctattgattcattgccttcaagttcattcactcaacctgtgccaaaagaaacaataccatccatggaagactctgatgtgtccttaacatcttcaccatatctgacctcttctataccttttggcttggactccttgacctccaaagtcaaagaccaattaaaagtgagccctttcctgccagatgcatccatggaaaaagagttaatatttgacggtggtttaggttcagggtctgggcaaaaggtagatctgattacttggccatggagtgagacttcatcagagaagagcgctgaaccactgtccaagccgtggcttgaagatgatgattcacttttgccagctgagattgaagacaagaaactagttttagttgacaaaatggattccacagaccaaattagtaagcactcaaaatatgaacatgatgacagatccacacactttccagaggaagagcctcttagtgggcctgctgtgcccatcttcgcagatactgcagctgaatctgcgtctctaaccctccccaagcacatatcagaagtacctggtgttgatgattactcagttaccaaagcacctcttatactgacatctgtagcaatctctgcctctactgataaatcagatcaggcagatgccatcctaagggaggatatggaacaaattactgagtcatccaactatgaatggtttgacagtgaggtttcaatggtaaagccagatatgcaaactttgtggactatattgccagaatcagagagagtttggacaagaacttcttccctagagaaattgtccagagacatattggcaagtacaccacagagtgctgacaggctctggttatctgtgacacagtctaccaaattgcctccaaccacaatctccaccctgctagaggatgaagtaattatgggtgtacaggatatttcgttagaactggaccggataggcacagattactatcagcctgagcaagtccaagagcaaaatggcaaggttggtagttatgtggaaatgtcaacaagtgttcactccacagagatggttagtgtggcttggcccacagaaggaggagatgacttgagttatacccagacttcaggagctttggtggttttcttcagcctccgagtgactaacatgatgttttcagaagatctgtttaataaaaactccttggagtataaagccctggagcaaagattcttagaattgctggttccctatctccagtcaaatctcacggggttccagaacttagaaatcctcaacttcagaaatggcagcattgtggtgaacagtcgaatgaagtttgccaattctgtccctcctaacgtcaacaatgcggtgtacatgattctggaagacttttgtaccactgcctacaataccatgaacttggctattgataaatactctcttgatgtggaatcaggtgatgaagccaacccttgcaagtttcaggcctgtaatgaattttcagagtgtctggtcaacccctggagtggagaagcaaagtgcagatgcttccctggatacctgagtgtggaagaacggccctgtcagagtctctgtgacctacagcctgacttctgcttgaatgatggaaagtgtgacattatgcctgggcacggggccatttgtaggtgccgggtgggtgagaactggtggtaccgaggcaagcactgtgaggaatttgtgtctgagcccgtgatcataggcatcactattgcctccgtggttggacttcttgtcatcttttctgctatcatctacttcttcatcaggactctccaagcacaccatgacaggagtgaaagagagagtcccttcagtggctccagcaggcagcctgacagcctctcatctattgagaatgctgtgaagtacaaccccgtgtatgaaagtcacagggctggatgtgagaagtatgagggaccctatcctcagcatcccttctacagctctgctagcggagacgtgattggtgggctgagcagagaagaaatcagacagatgtatgagagcagtgagctttccagagaggaaattcaagagagaatgagagttttggaactgtatgccaatgatcctgagtttgcagcttttgtgagagagcaacaagtggaagaggtttaaccaaaactcctgttctgaaactgattagaagcctggagaagatggagattacttgttacttatgtcatataattaacctggattttaaacactgttggaagaagagttttctatgaaaaaattaaatatagggcacactgtttttttttcagcttaagttttcagaatgtagtaagagatgttaccatttttatttctataaagactgaatgctgtgtttaaataaattgaaaactacgtaaactctggaaagtattctataagaaaaagctggacctaggatttagggctgcagttgctgtctgcttctgaatcactgggggtgtctcctaagaactgtgcctcgggtttttcaataggaaaataaggtgagactcttccatggagaagtctggcttagtaagggaatattttggagcatatttgttattgttgggtagaaggggaaacctttgaaatagtcttaatggatagtttataatcaggcattcatctaaataaaattctttcttttttttgatcaaactgctaaagaaaaagcaaacttttttgctgcaggatagaattcgggttgtatttttatgcttctatcagtgtcttgcatttcctgagcatattaatcaagaccatgttattgttatgttaactatgttaatatcctttttttcttagttttcaggatgaatgcatatatatatatatatatatatatatatatatatatatatatatatatatatataaagtttagaagattcccattaatctaaagacaaatttaatcacatgggcagggagggagtgagtgtcgggtcaagaccccagtgctgagaatatattttgtttcttgattgctggactgaggttccctgattgcttctgaaatctaaagatgtcttgggcaaatcctgtctctcctctagttcctggtgtattaatttggaaaacagcacttaactacctcacataatatagatgagctcattttcattgcttctcctttgtgtaatacctcctgtctaaattaactcctgcttatacaaaacagggcaaagcttttattacaattaaaatattttaaaaactgaacagataggaagtccataccttatataaattttgacagaaaatggaaattttcctctttccccctagtgttttttttgaatgggttgctttggagggggagaggaggaggccaaatcatcatcatcatgatattaaattgcatatgcaataggttattattaatgcagatactttatgctagatgtcttcatgcttgccaaaaccaattctgaacattttgatttatttctgaccagatataaataaccagtataaactgaccataagataaaatacttggttcacttttttttttctcaacttgatgactgccaattctgctcattatgaggacaccggaaactaaatatctgggctcagtgcatgccacagtaaagctagtgaaagccttgaagatggccaggtattttgcaaagtatgtatggataacaggttgtgtgtgtgtatgtgtgaatgtgtgtgtgcgtgtatgtgtgtgtgcgtgtgcgcgctaatgcgcatgtgcgcccgcgccaaggtggctcccttatcctagcatttcctttcattccctactcacataatggatcctctaacagttcagtataggtacactttccactattttattgacatgttctagtcttaatattggataattagacactttccactgggcccatttgaaaagtaattgataattacctttaagacattttaagtgttaatgatatttgtcactactaagtgcttagttttatttataaaactttcaaagttttctgtttaagactgtaaactgttttcctatactacgtgttagatgaaagtgtattttatcacaaattaaccttagaatgcaactctttgaatgtgtgcttgctggaagaattccagatggacacaaatccctctagggcaggtcaccatgcagaacacttaggagaagcacgaactgagccagaggagggttgttgttttccacaaactaagcagtgaagtgggaatttgggaattctgacacacgtcaccatctctgatttccttttgcgtgaccttttcatgcaagagcaaaacacttagctcttcatgaatgtctgctccacaccaatgaaatggaagagtaaaggagcccctcaactatcagggaaagaacaggaggcctcagttgaggaatacaacttttgtcctgcctttgctatagctgaaccactgttgaaaggttgaagaacacagtttgcccagcaaagatccatccactcatgtacaaagcaaagcactaaaggagctattagtttgatggaaaaaactacccctaaagagcttctttctaaaagaccttcctcgaaggtgatttaatggcatgtcatcatttaaaagtcttaggctgaactgtcatttacactgcacaattgaggaatgaaattttctgagtattagaacgttcttcttaacctagcaatataatattcaacaagactatcaccttatgtgaaaatactaaaatgcagttagcaataaaatgcatggtaaataaccattttaaaaatgttattataaaaggttgtaagatactgtggtgttttacagatgtagcctttataattgaattatatacactatccttttttatgggttatggataaaggggaatttatttgataaatagggctccattttcaccattgcaatggtttaagggtgtttgttcacgtttatgtggcctgaagtcccatttttatcactattattatttgagatggagtctcgctctgtcacccaggctggagtgcaatggggcgatctcagctcctggcaacctctgcctcctgggttcaagcgattctcgtgcttcagcttcctgagtagctggggttacagacacccaccaccatgcccagctaatttttatatttttagtagagatggggtttcaccgtcaccatgttggccagcctggtctcaaactcctgacctcaggtgatccacctgccttggcctcccaaagtgctgggattacaggcatgagccaccgcacctggccccatttaatttatataataaaacaagtgcaggctttacctgattttattctcaccttctgttttcttcttctgcattatctgtcaccatgggttggctcctccccactttctcttttttattcttttctctcttttttgccacactaaattgtaatgtgtttgaacaactctgacttaatattacctctaacaaaaagctggaaactgcacaaatattctttgtaggctctaaaagtaggttggctgaagtatgatacctgaactaattattcatttgtatgcttgttttataagtttgacttccatttcatgatttttttggtagctttatgttatttctgttttcagcaatgggtactttgacatctttctgtctctgaattgaattttcattttgcaacggaagagaagacaacatatttattccataatgaaagagctaatgaagtagaataactattaaattgagatgttttagcaaaaaaacaaaaacacaaaccccaaacgggttgttttgttttatttttttctaaaacatttctaacaattcccagtaggaatgggtggggccagccttcctcatttacaatccagctgcagtgagtcaagatcctagcttattctcccaattgtgtaataaatgcagaaaaatgatgtgacggtcactattctcaaatccattgcattgtattccacaaaggatatcctggcggaaggtggaaatatgggagggtaccatgatgtaaagaattgcctggaaatttccttgagtcatgcattttgtaaaaccttacattactgctatgagttaataagagacaggttaaaccactcccctcaggatagtaagactggttaaaaacactgctctcagcccacacagttatagctacagcctaggttaaatgattcctcatcctggtgtttttattctcatgtttaattacttctttaaagattaagattatatatagaaaaaataattgtggtatcagagaatacaggtataatttttcatatatcaggactatgtgatgatacttaagcaatagtgtacatacagtaatatatgtttaatatcgagtatggataatgaaggacttttctttttcaccttgtttataatgacattttatccagggtttgaatcaaataaattcatgttaactgtactattttattgaaatgttctagtcttattattggataattagaaataaacattttaaagtctttatgaataaataaggatgttttcctatgtatacaactgtactattttcattagtaataaacatcactttcaagaa

SEQ ID NO: 144198 - DNA, 3026 bp, Homo sapiens
  Payload ID: 8498
  Gene Symbol: ITSN1
  Gene Name: intersectin 1 (SH3 domain protein)
  ENST ID: ENST00000379960
  CDS Start-End: 39-752
ggatgtgaatggtgttgagctgttttttcttcataggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgttgctgtgttccttgtctgaagtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaaggcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgta

SEQ ID NO: 144199 - DNA, 1116 bp, Homo sapiens
  Payload ID: 8498
  Gene Symbol: ITSN1
  Gene Name: intersectin 1 (SH3 domain protein)
  ENST ID: ENST00000381283
  CDS Start-End: 33-1116
gcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggc

SEQ ID NO: 144200 - DNA, 949 bp, Homo sapiens
  Payload ID: 8498
  Gene Symbol: ITSN1
  Gene Name: intersectin 1 (SH3 domain protein)
  ENST ID: ENST00000381284
  CDS Start-End: 1-949
acccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggac

SEQ ID NO: 144201 - DNA, 6107 bp, Homo sapiens
  Payload ID: 8498
  Gene Symbol: ITSN1
  Gene Name: intersectin 1 (SH3 domain protein)
  ENST ID: ENST00000381285
  CDS Start-End: 269-2902
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttgcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgt

SEQ ID NO: 144202 - DNA, 5437 bp, Homo sapiens
  Payload ID: 8498
  Gene Symbol: ITSN1
  Gene Name: intersectin 1 (SH3 domain protein)
  Uniprot ID: Q15811
  ENST ID: ENST00000381291
  CDS Start-End: 269-3931
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggttaaaggggaatgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaa

SEQ ID NO: 144203 - DNA, 17015 bp, Homo sapiens
  Payload ID: 8498
  Gene Symbol: ITSN1
  Gene Name: intersectin 1 (SH3 domain protein)
  Uniprot ID: Q15811
  ENST ID: ENST00000381318
  CDS Start-End: 289-5454
ggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggttaaaggggaatgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgtgaaaaggaaaaatatcaagctggaggttgggaaagaaaatgaaggcagtccattatgtggtgggtgaaagaccctaggaggatgcaagccccgcacatcccggggcaaagacctaagacacttttccaccctccaccaccccaacctcacataatatgcttgttgcaagagtcaggactttatgactatgtgccaagctgtttggtttgagttctttaatttttttttcccttaaatgccaggagatcatctggttagttagatagtaacttgatttgctaatgaaaagtgggggccgtgttttgtttgcatgttaatattctcataatcctagtttgttgtggtcatgaaatgtcctttgcatgttctgttggtactggagtctagctttcctgtactagatggtgttctctttgattgtaggtccttagactttaattagggttatcaaagtgctttctaaatgatagcatcagcgttgtggcagagtacctcctttgctgggaactgaatgtgtagtgttatcatttcccatgagagcccggtcatacttcaagcaatttttttaaaagtgtgtgttggaaaggacaacaaagtttacatttcatacttttaagaaatactttattatttatttattgaagatagtgtagaattttgtatcaagaacaacagacataagtattttttgaaacaagcaaatataccctgtagttagaaactttcaactgaacatgttagagaccaagtttaacttcaggcatgcatttgtttaccatttcccagcagaaaacatggttaaaatactttaagtttatattttttgatgttgttaagaaacttttaaattaaatctataaatagacatgcaactcatgctttcctatttctataaccaacaccgtttgtttagtgtatttatgaaagatatgctaccatggtagaaagaaaagtattcaatgtgtaaatggggtagtgtgggtcaccattccgatctctttttgttttctgtcctgtcttttcttcattgactttatttgcgtgttaatgttggacatcattgttcatgtaggtagcgtatggtatgcacaatgacaaacaatcgttttaggtcccaggtcacccactcatagtgtcctattattggaattaatgtagcatgagaaagcaatatgtgactctttttcctcaagtgactctgttgagcatccttgagatgctcctgccatgtagcaagttctggattagtgtccttgtatttactggtgtaatttgtaatgtaaccaattgtccgtatggaggagtcgggctggccctcggacccagctgtgattcatgagttgtgtcacagggattgagaaacatgggtgatgcatggagtctcaaaccattgggcctctctgttccttcacctctaccttcttgaccacctgggctatatttcatagaaattaaatgctccttgccaacaaggagtctgtctcctagctctttgttttctaaatataggagttctctaggccactgcatcccggcatcctgatcccagccttttagacacccctgcaagcgttcctctgctctgagccacactgctagcttctcctgcacactctgatctcctttagcccaagaaggggctgtgctggtcatagggttatgctgtaaccctcagtcttccctgagaactgaactatcctgggacctcttgggctgagccttcttcacagagcagttctctagaaggcagagtccacatcctggtccctctggggcagggcctgtctggctgctggcatcaccctggcaggtggatggacagcatcatctcctggaaccaggtttgctgtgaccatgagagcctgaagatgtggctcattcggatccaggcctggactaatctggaaagagggactttctaggtgcaggtcaccagggatgcttgagaaactagagccagacttccttgtttgtttggataatatgtccctgtcctctgatagcagaggaaagagctctgctcccaaagaacattcatgtaagaggaggcatttttttcttctttgctttttttaaacaacctaaagtatgacctaagtgtatgaaactaactgatttctttgggtagagtagccctgaatttaactggggaaaaaatcccatcagactatgagtaaattgaccacccacattaagtcttatctcggtgacctggtaccaaagcccaggtgtcctccaggggagtattctggggtggcagggggattaggtgctagcgccagcagggaaggacacttgcaggtctgccttccaaggctaagcaggccggctgtctctccaggaactggctaggacaagtgtaaagccactgaccacacagaaccaggatgttctagaatctgatggggctgaagatgaagggagaaatggacaaggcacttctggctttattgaaaaggtgaagctcttggagtatattttagagtaggccagtaccttgtataagcagaaaaagacttctctatctccactccaagtcgtttttttctagttgattgggcctttttgattgataagaagaaaatgtgttttgtacgtgtaacaactttaagaatttccattggaaacaaagtatgatttgatttgatttgatttctaagttctcccttccttttcaaggttagcgatgtgctttatagcagacactagcacttttacatgaatacctggtgtgctttggatgtaacagggtcattttgggctcgaggtgagtgtgcaattagcagcaggtctgcttggtccagatatgcttgtttacaagtttagagcatcctatgccagaaagtgagatgaaaacaaaggcacctggattgctttgttttgcttttagataaaagagctttagctcacaccaggcagaagcataaccagtagccccagaaaccggtagcatgatgaagccctcagacagtatagtctgagccaccataagaggcattagggaaaactaacacctccttctttttgcaccgtggggtgctgaaattcctgctagagacttccccttacttccatgaatggcccaggggctgcttagtatatcattagaatgttcattctcctccttttccctggagtggaccagtgagaccaaatgcttgtgtttctctatgttttcagttcatttgttcaaatgacccagaagatgaatccatttctgggaaggctgagctcagatgaggattgctaggccagcctaggttctggggcggatctcagggacagaaacaggcttgtattaagtatgagtggcaggtacttctctagaacagccctaacctgcactagtgaggggggctcaggaattcccatgacattgatctagcagcctcctgcacgtagacactcagttcattttagggacgttcaatgcttgatcaaatggggggcattttctttctttctttttttccccagctacagtgtaattgcctacctgcctgggccccttctagaggaaggtgggctttccttgtccgtcaggctgcactcatgaggtgatatcgtaaagcagcagaaagactgagggtgcaaagaaaccacagctgccattcacggggcagctccctctagctcttctgcccagtgaccttacaggctttagaggagcctgatgagagctatcctgggggccaagggatgcattccctgcagcttcctcctgggggacccacaggtcagcccattccaggagaagcagtcttaggcccgtttgcatcccctgccactgccatgtgcctgccagcccggtttctgatgaagacgtggctcagtccctgctctccttgtcgcagtggcttgtacttcatgtgcagtagcccagggcccgccttctagagtgaatgtttccctcgagcccttggatatttttattctattttgaatggttccgatcaattaatgttgctttgtgtggggttcttcagagaaataatgcaaaccggccaggtgcggtggctcacacctgtaatcccaacactttgaggggctgaggcaggtggatcacctgaggtcaggagttcgagaacagcctggccaacgtggcgaaaccttgtctctactaaaaatacaaaaattagccaggggtggtggcaggcacctgtaatcccagctactcaggaggctgaggcaggagaatcactcgaacctgggaggcggaggttgcagtgagccgagatcacgccactgcactccagcctgggtaacagagcgagagtccttctcaaaacaaacaaaaaaagagctaatgcagacctcttctggttagacctgacacggaggaagtaattggctggtcaacttaatggcgccccacagcttcctctggatcctgcttctttgtacttggaacacagtttatttgagctagaggaaaggaaagttctagaattcctgtttcctcagcctgcactgtatcagatccaggatatgtctgcatttcatcaggatcaagtaagatacataaccttatatctgtaggagccagaaaaaaaaaaatctattcctgataggcatggaaacttagtccacatgaaagacagaagacatctaacagctgtctgtcttgggagcattaaaacccagacaccaagacacactagacagtccatctctgggttgtgatctctcagaaacatcttagtagttaatgcactgttcatttagggagtccccatcctggtccaggccaccctcctagaagctgggcggcagctggacgggcctgccttggtggcattcaagcaagcctaattggattaggttggtgcaaaagtgattgcggtttttgccattgcttttgatggcaaactaactttaagtcattaaaataagacccaacgcttataaaagagttcatatccacctcccaataacttctttagttccatgcagcctcaatcagttcctccattcaaaggaaccctctttaccctggccctgggggagccatattacacccacatcataatttttctgacactatgtgtgcttgtcaaatttcagggtcagtttccccttattggatgtcaggggtgttttgtgagttgtgttttaataggattctgttcgattttctataccagcctatattgttactatcatctgcctagtatgaatattttagtattcaaagcccaccagataaagctgtgttcagaagtggactttttggtcagccttgaaaaaaaaaaaatcagcatttctctgatatttcctgaggattaaccagaaactaaggtttctttttaggcagtggtaagaatgcgtattttcttcttccagaagttctggttttatacttttatcttttgaaagaataacattcctgtgcgactctgcttctcttcgcttttgcatttctcttttttaactcaaatctcttatttcctgccgttcctgtatctaaacagaatgggggcctcaggcagacaggaaccaaagaaagggtgtagtggctttgcagcgttgggtgagcagcagccgctgccattctgtgcactgtcaccggcgggggtggagggtctccctgtaggaggaggaaactcgctgttttcactggcagatttcaaggtgccggctccacctaccgcagctgctaggcattgctcttgtgtagatcgcagaaggagttattggtgatgtggggtgtaggggaagacaggaaaacggactcagagctaggaatgtgggcctggcagagaccgaaggctgggtgggaaggaagctcgcggcgagcctagggttcaagcctagcgcgccaggggtctccagtgagaccttgctcttccctgccgctgaggctggggctgcacggaggtcctcaggcttcccaccctttctgcatcagctttagtgtctgtcggctgggtggactgcagggcaggtgacctggaggaggccctgctccccagcaagcgttctaggagttacggtgtgctctattgggattggattacagtctctacttgtagactttgacttctggaattttaggtggaagggaatttttgttggtgggacgcagcagctcagtgcgtggtgtgtgcatgcgtgtttgtgcgtgcgtgtgcatgtatgtgtttgtgcgtgcacgtgtgcgtgtgtgtgcatgggtttgcgtgcatgcatgtgtgtgcgtgcgcgtgtttgtgtgtgcatgtgtgtgtgtctacgtgtgtgtgcacgcatgtgtgtgcgtgtatgtgtgcgtgtgtgcatgtttgtgagtgcatgtgtttgtgcgtgtgtgcgtatttgtgtgtgtgcgtgtgtgtgcgtgtgtatgtgcgtgtatgcatgtgcatgtttgtgtgtgcgtgcatatgtgtatgtgtgtgcgcgtgcgtgtgcgtgcatgtgtgcgcatgcgtgtgtacctacccacacctagggggatgcatggctctgtgccttggagagggaaacaggaaatacgttgctccacagtcctgtcatcctggtcaggactagtcgcgtggtttgcggacagagtgcaaaatgaaaatgcgaggccccttgttcaggtgatgaagcatttctagacagtgagaggagagcattaagccaagctcaggtcccttctgagtgcatagccccttgtggctgccaggcagcacacccaggaggccggccctgaccacactgttctctgctggttcccgaagctgatgggctctgtcttaggtcttcttactttgaaaggtctcccggcaggctgtggcaagctgcgcggatacacttttctaaacgtctgcatttatttcctaaaagcacaaatggcctggactagctagtgggtgtggaaccgagcccctagttcacagctgtaccccaaggctggagagggggttgccggtggtggcaggagctctgggctcccagttcaggatgggccacagggcgtcaagcagctgtgagcctttaccattgagctcactgcttggaaataaaacccttcctctgggccttgggcatccactgggagcttttctcccctttcctgggaggacagcaagccttttccaaccttctgccttcaaagagaagcagggtcatagaagtgctcagtgtcccttccccagtggctggacacttgctcctccagccttcaccccctggagagaaggggagtctgcggagccagtgcctccctgcccagctgggccacacgatctggtctgcgggtgtctgggaggaacctgcttcggagaggctgcgacctcccagctagactctccccttaggatcccatgtatggggatggtaggagagaaaagatccctctgtgtaagtagcctcaagttctagaagaccatggccccgggaggcagctgaccatgaagctgggcttcctgttgttgctttctttcacgagcttttacttttcctgggctggacgctccaaaatgtttgcagttccatttgctttttgcaagtaggtccccatctccatatacattgagcaataatcctcactatgtttcctgattctgtctgggattatatttgctaagtaaaaatgttgacagaaattgcaaactcatctcacctggatttgattgagtcaccttgaatgacataacaaattatggctttgttttcatgcgtcatgcaatcttccggactacgggaagttctgcaagtgttctccaggggcatttcattaatagcgtgtcagcattagttttaatgaatgaacatttgaggtacattctataaatcaatatccttaaaatgtcatctgctaaacattcactgtgacagaaagtagatattttagcaagatctatgttaatgctacttaattttagacatgcatttaaagcctacatggccaatagcccaagtatctttgaactgtgaaatcaacctcagatctcatctgctgtagccccgcaagccggagtctgtgccctccatgacccttcttatcccttggtggccctgcatagataggggagttggcccctgcccaccccgtgttgtattgccttagctccatcagctttgtaccctcacacgtataggtggtgaacttatgtgtaaatacatgtgtacagatgagaaactgcaacaaaaatgtcctgtggatgataatcagctcagtttccggttttctacattctgtgctgtttccagctaagaaaaaggcgaactcccactatataaagggaaaaggttgtattcatttcatgttcctcatgaaatctctgctgtatgtttatggaatggccatgactaaatgtatatatggtatgtaagaggccatgctgttaaatgttgcataaactaacacagattctgtagtcaaaaatatttaacttgttattgtaaaatgtgatttgtcattgagagattatttttctgtatgtatatgagagtattttaggaatctaatttaagtgcataaaactatagaaaaaaatttaaaacctattccaagagtagaaaatgcttaatgagattacttgggttcaactcaactaaatttcttatattaaaaaaaaattccaagttgtatatgttagaaatcaaatgagtcattttttttcctgcaggaaatatgataaatttcagtgtaatggatggtggcgtgatcaaatgaaaagtatcctgtagctatgacctcgcatgggaccttggtgttgcattaaaaatggatttttgcagatcacatatctgagagggtacttgtgtcaggaaggatgagaggatagggagcctgtttttcatcagatccatgtgccacgcaggcttccttgggttctagtggatttgttagggatctggggctgacgcagctatcccactagagaggccactctctgacttccaggtcgccctttctacttctgtatctggattgattcagtttatccctaattagcgtttgcgttttccatgaaatttcctgatgcatcctcactgtcttcaactgttgcatagccaggtgggtggatggatggtttagggtttctgagttaagccgttttggggcaggcttctggatgcccatgtttccatggagaccccagggggaagatgccttcctcccgtctgcattcccagaaaaggatcagaagtccaggctgcttctggggcacagactttctgtacttggccaccagaagtgccccttaggccacctaaggaggattctgtgaaactcaatgtctaaacccctgagaaaggcattcagaaatgatttcaggagggggcaaccccaggagtccagcctcccctggcagcctggaaatactgcagtaacaaaaagagctggtttctggtgatctgaatgcattgtgtttgggggtgacaccgctggtggaaggttgagggcctgtggtctgaaaagacatctgaagaatgtgttaggttttcaacatttctttgaacaggctgcgtgcatcttaatgctgtcaaccagcaactggagccccttttttgagaggcccgaaccagtaaagctgctgacttcaggagtatgggaagctgtgatttctggaagcttcctggaatctatttaggtgcatgaataatctgcaaatcacttagaggcactgtccatgtggtccataactggctttattcccaaagatggagctgttcagagatttctttgttcaggcgcagccttggaaggccacctaaggcctgccagcagaggagatgagctctggtctaccaaccccaaacaggccctgactctccttccttagaacgatgccctctggctggggtggcaagagggctgtgagtggaaacaagtcagccagtcaactgtcccttgggccttggttgtttcaaaaaagtctggggacaagaaaagctagaacatggggccctcccttcccaggagtgctagcgaaccctcccagatagcctttgcctgtttggaaaagaatgtaatccatcagaacgtgagctccttgtgcttccagtgacaagcgggccacagtgctggtggcatgttgcttccctcacagccctgcccaggggtaggaccaggcccgccccttgatggatgtgctgttgattgtaatatacttctgttgccaaataatggtactgtttaattttccataaaagagagactatattgtctgatatgtaatgttaatggaattctaagaattactagacactattataaattgtagacttacgtatttgtctaaaggtttgatgaagcagggccaaaacattgtttcttcttttttgtttgaaagaagctgaggtttgtttttgctgtttgagtgttcctttggcaacttattatgtgtgaaatgttaaattttaccgattaagatgatggtaactgagacctttctttaaaccagtagcaacatcagtacaaattgctcttcctgtgtatcttgaacctaaaaagaacaatctcttcaaaaacaaaaacaaaaacaaaaaacaactctttggtcattttgacctgtgtggtttaaattcaaatagttcatgaataaaaggagaaaagccaa

SEQ ID NO: 144204 - DNA, 3115 bp, Homo sapiens
  Payload ID: 8498
  Gene Symbol: ITSN1
  Gene Name: intersectin 1 (SH3 domain protein)
  Uniprot ID: Q15811
  ENST ID: ENST00000399338
  CDS Start-End: 20-3082
aggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatag

SEQ ID NO: 144205 - DNA, 5191 bp, Homo sapiens
  Payload ID: 8498
  Gene Symbol: ITSN1
  Gene Name: intersectin 1 (SH3 domain protein)
  Uniprot ID: Q15811
  ENST ID: ENST00000399349
  CDS Start-End: 249-3683
gaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagt

SEQ ID NO: 144206 - DNA, 5408 bp, Homo sapiens
  Payload ID: 8498
  Gene Symbol: ITSN1
  Gene Name: intersectin 1 (SH3 domain protein)
  Uniprot ID: Q15811
  ENST ID: ENST00000399352
  CDS Start-End: 251-3898
aggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 144207 - DNA, 3913 bp, Homo sapiens
  Payload ID: 8498
  Gene Symbol: ITSN1
  Gene Name: intersectin 1 (SH3 domain protein)
  Uniprot ID: Q15811
  ENST ID: ENST00000399353
  CDS Start-End: 347-3883
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttgcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggct

SEQ ID NO: 144208 - DNA, 4003 bp, Homo sapiens
  Payload ID: 8498
  Gene Symbol: ITSN1
  Gene Name: intersectin 1 (SH3 domain protein)
  ENST ID: ENST00000399355
  CDS Start-End: 249-3698
gaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggttaaaggggaatgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctt

SEQ ID NO: 144209 - DNA, 5722 bp, Homo sapiens
  Payload ID: 8498
  Gene Symbol: ITSN1
  Gene Name: intersectin 1 (SH3 domain protein)
  Uniprot ID: Q15811
  ENST ID: ENST00000399367
  CDS Start-End: 264-5414
agggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggatgaggccccagacttcaaggagttcgtcaaaagattggcaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagagcaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttccc

SEQ ID NO: 144210 - DNA, 1330 bp, Homo sapiens
  Payload ID: 8498
  Gene Symbol: ITSN1
  Gene Name: intersectin 1 (SH3 domain protein)
  ENST ID: ENST00000437442
  CDS Start-End: 617-1330
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgttgctgtgttccttgtctga

SEQ ID NO: 144211 - DNA, 936 bp, Homo sapiens
  Payload ID: 8498
  Gene Symbol: ITSN1
  Gene Name: intersectin 1 (SH3 domain protein)
  ENST ID: ENST00000440794
  CDS Start-End: 1-781
agtcatggttaaaggggaatgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatagtgctttgtggttaataaagtgcttttccctaaattatctgggggaggcagagactgtttttttcatctgtaatctcatggggcagtgcatgtagatgtacaataaatggtaattacaatgaa

SEQ ID NO: 144212 - DNA, 827 bp, Homo sapiens
  Payload ID: 8498
  Gene Symbol: ITSN1
  Gene Name: intersectin 1 (SH3 domain protein)
  ENST ID: ENST00000444491
  CDS Start-End: 482-827
agatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtttaagctgtcaccttcccaaatgcggcatctgtgtagccccagagggagcattctaaaaggcagcacttagatgagttgatcccttcacaccccacccagcagttcgttctacctggcaaaacttaacagcttcggtgaagaaacctccacattactgaacatttggaggtgtcccaatgaaaaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttg

SEQ ID NO: 144213 - DNA, 501 bp, Homo sapiens
  Payload ID: 8498
  Gene Symbol: ITSN1
  Gene Name: intersectin 1 (SH3 domain protein)
  ENST ID: ENST00000451686
  CDS Start-End: 267-501
gttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtttaagctgtcaccttcccaaatgcggcatctgtgtagccccagagggagcattctaaaaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagtttt

SEQ ID NO: 144214 - DNA, 422 bp, Homo sapiens
  Payload ID: 8498
  Gene Symbol: ITSN1
  Gene Name: intersectin 1 (SH3 domain protein)
  ENST ID: ENST00000420666
  CDS Start-End: 1-200
tggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattc

SEQ ID NO: 144215 - DNA, 519 bp, Homo sapiens
  Payload ID: 8498
  Gene Symbol: ITSN1
  Gene Name: intersectin 1 (SH3 domain protein)
  ENST ID: ENST00000415023
  CDS Start-End: 1-519
gaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactctacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggac

SEQ ID NO: 144216 - DNA, 485 bp, Homo sapiens
  Payload ID: 8498
  Gene Symbol: ITSN1
  Gene Name: intersectin 1 (SH3 domain protein)
  ENST ID: ENST00000456489
  CDS Start-End: 1-181
cagggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggaggtaattctgtctgaaaaatgatggccccctgcaggaagatagtgctggggagaagaaggagcatgttcacatttgaaccctgggatgtaaagtaatcaaaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcaca

SEQ ID NO: 144217 - DNA, 514 bp, Homo sapiens
  Payload ID: 8498
  Gene Symbol: ITSN1
  Gene Name: intersectin 1 (SH3 domain protein)
  ENST ID: ENST00000437126
  CDS Start-End: 1-232
gtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagggctctggaactgctgggaaaacagggagtttaggaaaaaaacctggtccctcctgtaacgtgaaataaaaagaaagaaatttgccctgccatgatttgcacctgatattcagggatcactctcaaaataaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagag

SEQ ID NO: 144218 - DNA, 779 bp, Homo sapiens
  Payload ID: 8498
  Gene Symbol: ITSN1
  Gene Name: intersectin 1 (SH3 domain protein)
  ENST ID: ENST00000419241
  CDS Start-End: 1-234
catcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcatggggaatgggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctca

SEQ ID NO: 144219 - DNA, 6300 bp, Homo sapiens
  Payload ID: 8499
  Gene Symbol: ITSN2
  Gene Name: intersectin 2
  Uniprot ID: Q9NZM3
  ENST ID: ENST00000355123
  CDS Start-End: 445-5538
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaa

SEQ ID NO: 144220 - DNA, 5814 bp, Homo sapiens
  Payload ID: 8499
  Gene Symbol: ITSN2
  Gene Name: intersectin 2
  Uniprot ID: Q9NZM3
  ENST ID: ENST00000361999
  CDS Start-End: 40-5052
cgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaa

SEQ ID NO: 144221 - DNA, 4563 bp, Homo sapiens
  Payload ID: 8499
  Gene Symbol: ITSN2
  Gene Name: intersectin 2
  Uniprot ID: Q9NZM3
  ENST ID: ENST00000406921
  CDS Start-End: 239-3988
ggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtgaggaggctgctgctggctagctctcggggtatctgctgtctctcatgagagatggtgggcatcagactcagggctgcctccacgcagagtcaaagcaaggcatcacttttgatgtgtgaattcacaaatagtgacggaagctctcacatcctccaaatgctgtctctgcctgccggataatgcttgagattgaaagtctctaatgagctctttcccccagatgaggtcactcagagtgaagcgggagaacaagagggcattcgcatggcttcgttggatgtggcaggagccccatcaaggaaggacggggatagagtggatgggaagggcctatggcagaccgtagcttccttggatatttgcctaatatctgttttaacatctgacattttcataaactggtatctctggaggaactgtgaaacagtgaaagtgttcacctcatggttgtatcagtttggaaaacccaatgggagcatattgtaaaatagttcccaaatatcatatagctactgtttgtttataccagtgacctctacgctgatgacagctatccttattcgagtagcactttaaaatgatttgtgcttgagtgaacaaaagaagactttccatttctacta

SEQ ID NO: 144222 - DNA, 3634 bp, Homo sapiens
  Payload ID: 8499
  Gene Symbol: ITSN2
  Gene Name: intersectin 2
  ENST ID: ENST00000416160
  CDS Start-End: 1-362
gccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatttgtttaaaggccaagaactggaaacagccatgccctgttttctgtgtatttgggatgggaataacaacattttgggggagctttttaaatctcagagaagaggaaagtggcctgctctggcaggtatgtgcagtgtttcatttgttccagtcccaagaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgtgggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttataatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcacttcacttttacactgataaatataaattactgggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactata

SEQ ID NO: 144223 - DNA, 2066 bp, Homo sapiens
  Payload ID: 8499
  Gene Symbol: ITSN2
  Gene Name: intersectin 2
  ENST ID: ENST00000412011
  CDS Start-End: 240-2066
gggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtaggagctggagctcaggtagtagtgctcactcacctgccactcaccgagccccgctgtccagcccggttcctaacagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaa

SEQ ID NO: 144224 - DNA, 902 bp, Homo sapiens
  Payload ID: 8499
  Gene Symbol: ITSN2
  Gene Name: intersectin 2
  ENST ID: ENST00000443927
  CDS Start-End: 352-902
ggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgagcgggaggcgcggcgagggcgccagatggctgagagctagcaaggaaaactcaggaccatgatggctcagtttcccacagctatgaatgaacctattatttaaggattaatgttaatgctgggggctcagtgagttgctgcatataaagtccctgacaatagtcagggttcaataaaggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatggg

SEQ ID NO: 144225 - DNA, 974 bp, Homo sapiens
  Payload ID: 8499
  Gene Symbol: ITSN2
  Gene Name: intersectin 2
  ENST ID: ENST00000427234
  CDS Start-End: 1-167
aggaactgcacggattcctcttcaatgacttcctgcttcttacctacatggtcaagcagtttgctgtttcctctggctctgagaaacttttcagctcgaagtccaatgctcaattcaaaatgtataaaacggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccacc

SEQ ID NO: 144226 - DNA, 252 bp, Homo sapiens
  Payload ID: 8499
  Gene Symbol: ITSN2
  Gene Name: intersectin 2
  ENST ID: ENST00000449392
  CDS Start-End: 1-109
cgcctgggtgcagaagatcaaggcggcgtctgagcagtacatcgacaccgagaagaagaagcgtgagaaagcttaccaaggtttcccccattttgttatatactcctaaaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccagg

SEQ ID NO: 144227 - DNA, 5805 bp, Homo sapiens
  Payload ID: 8499
  Gene Symbol: ITSN2
  Gene Name: intersectin 2
  ENST ID: ENST00000622089
  CDS Start-End: 4-5046
cagatggctgagagccaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatg

SEQ ID NO: 144228 - DNA, 6116 bp, Homo sapiens
  Payload ID: 8500
  Gene Symbol: ICK
  Gene Name: intestinal cell (MAK-like) kinase
  Uniprot ID: Q9UPZ9
  ENST ID: ENST00000350082
  CDS Start-End: 348-2246
gcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccagcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaattgatttgagtgttctgtttttgt

SEQ ID NO: 144229 - DNA, 6227 bp, Homo sapiens
  Payload ID: 8500
  Gene Symbol: ICK
  Gene Name: intestinal cell (MAK-like) kinase
  Uniprot ID: Q9UPZ9
  ENST ID: ENST00000356971
  CDS Start-End: 491-2389
ggaaaacggccgggttcctgctgcactaccatgcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccaagaagagtattcctttccacttacaactaaataagacctgcttttgctggagctgtgctaggctgagggaattccacactgaattttacaagcgggatggatttctctaaggcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagttt

SEQ ID NO: 144230 - DNA, 3384 bp, Homo sapiens
  Payload ID: 8501
  Gene Symbol: ISX
  Gene Name: intestine-specific homeobox
  Uniprot ID: Q2M1V0
  ENST ID: ENST00000308700
  CDS Start-End: 953-1690
agatcaacaactgtcagctcccagtcagagagaaagggcctcttcagtctgtctcaggagactgggagaaacagcataaaggaccccacaaggaagggagaggtaccctgggtcaggcgcttgtggagagagggcttcgcatgtaaagtgacgtcagggaaaatagaacagaaaaaaagccagggccagcccagaggcacctgagaagaatcagacccacagctcagcccagccctggcacagagaagagacaggcctggcagcacccagggaccccctttcctcagcctccacctgcaggacagcaggagcactgatgcgctgaaggtacgttctggagtctggaagcagcagaactgaaggaagtaaacacgggtgtctgggaagacccctcaagctgcagtaaagcccaggactgaattggccacctgaggccaagggtggcactccaacctcctcctaaaggctggctagagccacaggaaagggccagaagccagagaaagggcaaaggtggacccctgcctccaaacctcctctggagactgacctcctctttcctgtgccttattgtttctccctcttctctttgttcgccactgggcggtgacctcagggatcctggcctaacctggtgattgtgcaggcaactgtgtccgagaagacccttctctggaagattgaaccccaattcagccatggtgactcctttgatgtcaaactggtaagggctgagccgtgggcacaggataccactccttccagctcttctgctgtgacctgcccatggaagtccctgtggacacgaaatcctgtttggatcatctaactggaggctctctgttcttcacctccacgcgccctcttgaccccaggaggttcaggggaggaagtacgccactctccactggcaccctccttggcctacacagagtcacccctgagcccctcaatgtgtgctgaggtgggccctgctctctgcaggggtatggagagaaatagcttggggtgctgtgaggccccgaagaagctgagcctgtccttctccattgaggcgatcctaaagaggcctgccaggaggagtgatatggacagaccagaagggccaggtgaagagggccccggagaagctgcggcctcaggctctgggctagaaaagcctccaaaggaccagccccaggaaggaaggaagagcaagcggagggttcgtaccaccttcaccactgagcagctgcatgagctggagaagatcttccactttacccactacccagacgttcacatccgcagccagctggcagccaggatcaacctcccagaagctcgggtgcagatctggttccagaatcagcgagccaagtggcggaagcaggagaagattggcaacctgggggctccacagcagctgagtgaagccagtgtggccctgcccacaaatctggatgtggctgggcccacgtggacatccactgctctgcgcaggctggctcctcccacgagctgttgtccatcggctcaagatcagctggcctctgcctggttccctgcctggatcaccctcctcccagcgcacccatgggaaacacagcctgtcccaggtcttcccatccatcaaacttgcatccctgtgctatgcatccttccacctccacaccccaaatggggcagcatctgtgctacttcaacatagagattggacatgctctccccaaatgagccactttcctctccaggtgaaggcaggtagcagatgtgccctgggcctctggggaaatcgatttcacaatccaaaaatggcccacagcccaggaagctaccctgaacatgccagttggaaggctgcaccagactcaaaagcaaactaaacaataaaggacagctctcttctctcctggctaaagctgctctcctggttcagaagacaggctggatgagatctcaggccgagctctgaaatagggaggtaatcctccagcacctgtgtttcctctaacttgctgtgtgacctccagccggtcactcaccctctctggacctcatctgtaagaggagccagctggataagatgatttctgaagacgcttccatggtgggcactgaggcacagaggaggccaaggagaggttgtttgttcatgcatgcattcatccgtgacacatgagtacctactgaggactccataaacagaacgggatacagagataaacaatttgggttctgtccacgtttgtcaaaaggtggtgctggcccacctctgaaagcagaacacttgctcaacaaccttgctgttggcccaagtctaacacattctttatgactgtgagcatctcagagtgagagaaaaatgtagaaagttttttaaattctaaacaggatttagtgtctttagttatcttgctggatgggaaagggatgttgtcatttctggcacaaatgaaaagtaggacggaaagctcctttcattcagtttatctttccaggatatatgaaaagggaccagctggaagactagcctcactctgtcctcgaaagcctgagctttcattcaactccctatttccatgcaaagacgctgggcaaaccacatgttctgtctgagcctcagttttcctatccataaaatgaaggtagccaggcctgcctcaaagagcattcaggaggctctgagaggacatgagagtattttgcaaagtgagggcaaggcccagtgtggagtgatattgttattccaagattccactgcaaaagtggctgctttggatgccagcccaggatgagtagttcctgttctcagggaggtcatccgctgagcatcccttctgcacagatgtctctgattcttgtccttgcaggtggaggacagggcctgctcccctaagctgggaagcctggaatgacctcttgcacaagcctaaattccaggaatcttccccaaatcccagatcctctgcaatctacctgcacccctgacccacccaggagttggaccgggagttgggaagcctaggtcttagtcctacactccttctaatttgctgtgtaaccttaccattaatctctctgggtctcagttttctcatctgtattggaggtagcagtgctagctctgccttcaggcatgcaatatgccagaactacagacaacagcccacaggatgcaaaagtgctttgccatcttaaaaatgccagatcactcagagcctatgaatgtggatatcaacaccaggtctctagcaccgctggatgaaaggagaaggctagaggctgagggaggaaagagcagttaacaaacaaaggcagtagctcatcacttgggtagcaggtacccattttaggaccctacactcaaatgtgcaaaataaaatttctatcattttgctataa

SEQ ID NO: 144231 - DNA, 3094 bp, Homo sapiens
  Payload ID: 8501
  Gene Symbol: ISX
  Gene Name: intestine-specific homeobox
  Uniprot ID: Q2M1V0
  ENST ID: ENST00000404699
  CDS Start-End: 664-1401
agatcaacaactgtcagctcccagtcagagagaaagggcctcttcagtctgtctcaggagactgggagaaacagcataaaggaccccacaaggaagggagaggtaccctgggtcaggcgcttgtggagagagggcttcgcatgtaaagtgacgtcagggaaaatagaacagaaaaaaagccagggccagcccagaggcacctgagaagaatcagacccacagctcagcccagccctggcacagagaagagacaggcctggcagcacccagggaccccctttcctcagcctccacctgcaggacagcaggagcactgatgcgctgaagggatcctggcctaacctggtgattgtgcaggcaactgtgtccgagaagacccttctctggaagattgaaccccaattcagccatggtgactcctttgatgtcaaactggtaagggctgagccgtgggcacaggataccactccttccagctcttctgctgtgacctgcccatggaagtccctgtggacacgaaatcctgtttggatcatctaactggaggctctctgttcttcacctccacgcgccctcttgaccccaggaggttcaggggaggaagtacgccactctccactggcaccctccttggcctacacagagtcacccctgagcccctcaatgtgtgctgaggtgggccctgctctctgcaggggtatggagagaaatagcttggggtgctgtgaggccccgaagaagctgagcctgtccttctccattgaggcgatcctaaagaggcctgccaggaggagtgatatggacagaccagaagggccaggtgaagagggccccggagaagctgcggcctcaggctctgggctagaaaagcctccaaaggaccagccccaggaaggaaggaagagcaagcggagggttcgtaccaccttcaccactgagcagctgcatgagctggagaagatcttccactttacccactacccagacgttcacatccgcagccagctggcagccaggatcaacctcccagaagctcgggtgcagatctggttccagaatcagcgagccaagtggcggaagcaggagaagattggcaacctgggggctccacagcagctgagtgaagccagtgtggccctgcccacaaatctggatgtggctgggcccacgtggacatccactgctctgcgcaggctggctcctcccacgagctgttgtccatcggctcaagatcagctggcctctgcctggttccctgcctggatcaccctcctcccagcgcacccatgggaaacacagcctgtcccaggtcttcccatccatcaaacttgcatccctgtgctatgcatccttccacctccacaccccaaatggggcagcatctgtgctacttcaacatagagattggacatgctctccccaaatgagccactttcctctccaggtgaaggcaggtagcagatgtgccctgggcctctggggaaatcgatttcacaatccaaaaatggcccacagcccaggaagctaccctgaacatgccagttggaaggctgcaccagactcaaaagcaaactaaacaataaaggacagctctcttctctcctggctaaagctgctctcctggttcagaagacaggctggatgagatctcaggccgagctctgaaatagggaggtaatcctccagcacctgtgtttcctctaacttgctgtgtgacctccagccggtcactcaccctctctggacctcatctgtaagaggagccagctggataagatgatttctgaagacgcttccatggtgggcactgaggcacagaggaggccaaggagaggttgtttgttcatgcatgcattcatccgtgacacatgagtacctactgaggactccataaacagaacgggatacagagataaacaatttgggttctgtccacgtttgtcaaaaggtggtgctggcccacctctgaaagcagaacacttgctcaacaaccttgctgttggcccaagtctaacacattctttatgactgtgagcatctcagagtgagagaaaaatgtagaaagttttttaaattctaaacaggatttagtgtctttagttatcttgctggatgggaaagggatgttgtcatttctggcacaaatgaaaagtaggacggaaagctcctttcattcagtttatctttccaggatatatgaaaagggaccagctggaagactagcctcactctgtcctcgaaagcctgagctttcattcaactccctatttccatgcaaagacgctgggcaaaccacatgttctgtctgagcctcagttttcctatccataaaatgaaggtagccaggcctgcctcaaagagcattcaggaggctctgagaggacatgagagtattttgcaaagtgagggcaaggcccagtgtggagtgatattgttattccaagattccactgcaaaagtggctgctttggatgccagcccaggatgagtagttcctgttctcagggaggtcatccgctgagcatcccttctgcacagatgtctctgattcttgtccttgcaggtggaggacagggcctgctcccctaagctgggaagcctggaatgacctcttgcacaagcctaaattccaggaatcttccccaaatcccagatcctctgcaatctacctgcacccctgacccacccaggagttggaccgggagttgggaagcctaggtcttagtcctacactccttctaatttgctgtgtaaccttaccattaatctctctgggtctcagttttctcatctgtattggaggtagcagtgctagctctgccttcaggcatgcaatatgccagaactacagacaacagcccacaggatgcaaaagtgctttgccatcttaaaaatgccagatcactcagagcctatgaatgtggatatcaacaccaggtctctagcaccgctggatgaaaggagaaggctagaggctgagggaggaaagagcagttaacaaacaaaggcagtagctcatcacttgggtagcaggtacccattttaggaccctacactcaaatgtgcaaaataaaatttctatcattttgctata

SEQ ID NO: 144232 - DNA, 1947 bp, Homo sapiens
  Payload ID: 8502
  Gene Symbol: IPP
  Gene Name: intracisternal A particle-promoted polypeptide
  Uniprot ID: Q9Y573
  ENST ID: ENST00000359942
  CDS Start-End: 105-1853
cgcgactgcgcgcgcagggcctgagcgggcgccggagggaaggggaagcggcggggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgttgtaccgattctaggaattgaagcaggaatctttcagatacttctagatttcatttacacaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcaaatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctattggaggtgaaaaggattcaatgatttttgattgtactgaatgctatgatccagttactaaacagtggacaactgtagcttcgatgaatcatccccgctgcggcttaggagtgtgtgtgtgttatggggctatctatgctttgggtggatgggttggagctgagatagggaacaccattgaacgatttgatcctgatgaaaataaatgggaagtagttggtaacatggctgtgtcacgctactactttgggtgctgtgaaatgcaaggtttaatttatgtaattgggggcatcagcaatgaaggaatagaacttcgttcttttgaagtctatgatccactttctaagcgttggtctccacttcctccaatgggaaccaggagagcatatcttggtgtggctgcactcaatgactgcatctattctgttggaggatggaatgagacccaagatgctcttcatactgtagaaaaatattcctttgaagaggaaaagtgggttgaagttgcctcaatgaaagtgcctagagcaggcatgtgtgttgtggcagtcaatggtcttctgtatgtttctggaggtcgatcttccagccatgattttttggctccagatactcacagatacgaggttttccgcttgaagtgggagaatatgtgcattcttttcaatgatcacaagactctaacaaaggggatttttaatctttaattttcaagatggttaaaatattgaaatgtttaagtggataactatattattcataaaatgactgagtgaaaactaatatactatgagatgaaaa

SEQ ID NO: 144233 - DNA, 3113 bp, Homo sapiens
  Payload ID: 8502
  Gene Symbol: IPP
  Gene Name: intracisternal A particle-promoted polypeptide
  Uniprot ID: Q9Y573
  ENST ID: ENST00000396478
  CDS Start-End: 104-1858
gcgactgcgcgcgcagggcctgagcgggcgccggagggaaggggaagcggcggggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgttgtaccgattctaggaattgaagcaggaatctttcagatacttctagatttcatttacacaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcaaatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctattggaggtgaaaaggattcaatgatttttgattgtactgaatgctatgatccagttactaaacagtggacaactgtagcttcgatgaatcatccccgctgcggcttaggagtgtgtgtgtgttatggggctatctatgctttgggtggatgggttggagctgagatagggaacaccattgaacgatttgatcctgatgaaaataaatgggaagtagttggtaacatggctgtgtcacgctactactttgggtgctgtgaaatgcaaggtttaatttatgtaattgggggcatcagcaatgaaggaatagaacttcgttcttttgaagtctatgatccactttctaagcgttggtctccacttcctccaatgggaaccaggagagcatatcttggtgtggctgcactcaatgactgcatctattctgttggaggatggaatgagacccaagatgctcttcatactgtagaaaaatattcctttgaagaggaaaagtgggttgaagttgcctcaatgaaagtgcctagagcaggcatgtgtgttgtggcagtcaatggtcttctgtatgtttctggaggtcgatcttccagccatgattttttggctccaggtaccttggactcagttgaagtttataaccctcattcagatacatggacagaaattggtaacatgatcaccagtcgttgtgaagggggcgttgctgtgctatgaaatataaagcataacagagcacaaggaacattttgaaaatgcaggacctgaccttttgcaaagcaaacatagatttggtgataagaccctctgattctgtgagttttccatgtatttggtagataaatgactaacgaggctgggcgcagtggcctcatgcctataatcccagcactttggaaggctgaggcagaaggatcacttgagcccaggaatttgaggttgtagtaagctacgatcatgccactgcactccactctgggcaacagaatgagatcctgtctcttaaagaaaaaaaataaactcaagaatgatttttctaaaaatatgagtgagaatggatatggaatatatcccaattaataaagagctcacacagatttgccaggtttactaataatagaaatgccatttatgctgtagaattctccagtttaagtgtagacaactcctattttacaaatttgtagaaattatttactagaagcttcctggcaaatagtccctttagctacttctccagtgcagtataaattgtaacataaaactttatgtgatataggaatagtgtcaatgacacagtttaaagacctctatattcacaattatatccagagcataattttccatggccatagtttgagccacagagaaagccaatgaaatagattcctacttttatttaatgccaagagttttcactagccccaaactttttattggcagcagatatcctaggaggggtgtttgggaaatatctagctattttaatagatagatacctttttgcttgatgataagtttttgcttgctcatattttttgtcttgatcctgagaatgcaagtaaggaattaataggaggttcttagtgaccagatgttgtaatgggctatacagtccagcaggcagtatgcacctagaaatttctcccttttttaggctgggcatggtggctcacacctgtaatcccagcactttgagaggccgaggtgagacgggaagatggcttgaactcaggagttcgagactagcctgggcaacgtgatgagactccgtctctaccaaaaaatatataaaaattagccgggcgttgtggcttgtacctgtggtcccatctgcttgggaggctgaggttgcaggatcacttgagcccaggaggtcaaggctgcagtgagccaagattgtgccactgcacaccggcctgggtgacagcatgagaacctgtctcaaaaaaaaaaaaaaaaaaagaaaaaa

SEQ ID NO: 144234 - DNA, 4151 bp, Homo sapiens
  Payload ID: 8503
  Gene Symbol: IFT122
  Gene Name: intraflagellar transport 122
  Uniprot ID: Q9HBG6
  ENST ID: ENST00000296266
  CDS Start-End: 193-4071
ttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacatcttggtctgtgatgtcttcattgcacctccatcttccatttctgggcctccacaaaacagtaagagtaacagccacagataaagcacctaaaggccaaggtgggaggattgattgcttgaggccaagcgttcaaaaccaacctggccaaaagcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactg

SEQ ID NO: 144235 - DNA, 3841 bp, Homo sapiens
  Payload ID: 8503
  Gene Symbol: IFT122
  Gene Name: intraflagellar transport 122
  Uniprot ID: Q9HBG6
  ENST ID: ENST00000347300
  CDS Start-End: 207-3755
attgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaa

SEQ ID NO: 144236 - DNA, 3877 bp, Homo sapiens
  Payload ID: 8503
  Gene Symbol: IFT122
  Gene Name: intraflagellar transport 122
  Uniprot ID: Q9HBG6
  ENST ID: ENST00000348417
  CDS Start-End: 78-3803
ggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagtt

SEQ ID NO: 144237 - DNA, 3569 bp, Homo sapiens
  Payload ID: 8503
  Gene Symbol: IFT122
  Gene Name: intraflagellar transport 122
  Uniprot ID: Q9HBG6
  ENST ID: ENST00000349441
  CDS Start-End: 88-3483
cttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagcagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaa

SEQ ID NO: 144238 - DNA, 4007 bp, Homo sapiens
  Payload ID: 8503
  Gene Symbol: IFT122
  Gene Name: intraflagellar transport 122
  Uniprot ID: Q9HBG6
  ENST ID: ENST00000440957
  CDS Start-End: 667-3765
attctcgaggaagacgcaccgcccccacacgccccgaccaatcgctcgcgctctggttgcgctggcgccttaggggctccagtgccaccattgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaatgtgtttcttgcccagatgaagtttgtgttttgtggggggggccttgtgtaaccacggaattcctatttatggcatttcatgccttgtaaatagcaccaggagatgaggaagagaatgtacatatattttctaaggaaaaaaatctgttactttca

SEQ ID NO: 144239 - DNA, 4414 bp, Homo sapiens
  Payload ID: 8503
  Gene Symbol: IFT122
  Gene Name: intraflagellar transport 122
  Uniprot ID: Q9HBG6
  ENST ID: ENST00000431818
  CDS Start-End: 897-4172
attctcgaggaagacgcaccgcccccacacgccccgaccaatcgctcgcgctctggttgcgctggcgccttaggggctccagtgccaccattgcttttgctgcttttctggctttccctttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggaaatgaaagctcttcagtagcttgtttgggtcatgcagctggtcagtgagatctctaggaattctgacccagagactctgagcccaaagcttatgcttttcatcaccatcacctgctacctaccaggatgagggaggagtgatggaaatagcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaatgtgtttcttgcccagatgaagtttgtgttttgtggggggggccttgtgtaaccacggaattcctatttatggcatttcatgccttgtaaatagcaccaggagatgaggaagagaatgtacatatattttctaaggaaaaaaatctgttactttca

SEQ ID NO: 144240 - DNA, 329 bp, Homo sapiens
  Payload ID: 8503
  Gene Symbol: IFT122
  Gene Name: intraflagellar transport 122
  ENST ID: ENST00000508826
  CDS Start-End: 1-329
tataaatgacatcgcatttaagcctgatggaactcaactgattttggctgccggaagcagattactggtttatgacacctctgatggcaccttacttcagcccctcaagggacacaaagacactgtgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatac

SEQ ID NO: 144241 - DNA, 4057 bp, Homo sapiens
  Payload ID: 8503
  Gene Symbol: IFT122
  Gene Name: intraflagellar transport 122
  ENST ID: ENST00000512220
  CDS Start-End: 99-341
agccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggaaatgaaagctcttcagtagcttgtttgggtcatgcagctggtcagtgagatctctaggaattctgacccagagactctgagcccaaagcttatgcttttcatcaccatcacctgctacctaccaggatgagggaggagtgatggaaatagcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagccgatgggagagtttctggatgaacagagagaatgaggatgccgaggatgtcattgtcaacagatatattcaggaaatcccttccactctgaagtcagcagtgtacagtagtcagggtagtgaggcagaggaggaagaaccagaggaagaggacgacagtcccagggacgacaacttagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtc

SEQ ID NO: 144242 - DNA, 3541 bp, Homo sapiens
  Payload ID: 8503
  Gene Symbol: IFT122
  Gene Name: intraflagellar transport 122
  Uniprot ID: Q9HBG6
  ENST ID: ENST00000504021
  CDS Start-End: 95-3451
aaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgtattgtgcattgaagggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagcagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcagaatgtg

SEQ ID NO: 144243 - DNA, 584 bp, Homo sapiens
  Payload ID: 8503
  Gene Symbol: IFT122
  Gene Name: intraflagellar transport 122
  ENST ID: ENST00000511498
  CDS Start-End: 295-584
gttctgattcctgatgtcctgtcctggaataactgaaaatctgggctaaaaatgctaaaatgcattcagaatatggtgattttatcctgagagagttaatactacttctctaccttcaatggctgaggggaggctgacagttattctttaaattgtgtggaaaccaagacagtgaatggtgacctttactctgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctct

SEQ ID NO: 144244 - DNA, 962 bp, Homo sapiens
  Payload ID: 8503
  Gene Symbol: IFT122
  Gene Name: intraflagellar transport 122
  ENST ID: ENST00000515783
  CDS Start-End: 1-962
tataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgggttgtggtctcctgaacagaagtctgtctccaaacacaaatcaagcagcaagatcatctgctgcagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatg

SEQ ID NO: 144245 - DNA, 418 bp, Homo sapiens
  Payload ID: 8503
  Gene Symbol: IFT122
  Gene Name: intraflagellar transport 122
  ENST ID: ENST00000510524
  CDS Start-End: 1-337
tataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacagtcttgctctgttgcccaggctggagtgcagtggcacgatctcggctcaccgcaagctccacctcccaggttcacgccattctcctgcctcagcctcccgagtagctgggactataggcgctcaccaccatgccaggcacaatgatgctatacaatgtgtctcctacaatcctattactcatcaac

SEQ ID NO: 144246 - DNA, 296 bp, Homo sapiens
  Payload ID: 8503
  Gene Symbol: IFT122
  Gene Name: intraflagellar transport 122
  ENST ID: ENST00000514275
  CDS Start-End: 1-296
tataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcag

SEQ ID NO: 144247 - DNA, 734 bp, Homo sapiens
  Payload ID: 8503
  Gene Symbol: IFT122
  Gene Name: intraflagellar transport 122
  ENST ID: ENST00000512157
  CDS Start-End: 1-734
tataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacaggg

SEQ ID NO: 144248 - DNA, 1141 bp, Homo sapiens
  Payload ID: 8503
  Gene Symbol: IFT122
  Gene Name: intraflagellar transport 122
  ENST ID: ENST00000509522
  CDS Start-End: 1-1141
gaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaag

SEQ ID NO: 144249 - DNA, 3824 bp, Homo sapiens
  Payload ID: 8503
  Gene Symbol: IFT122
  Gene Name: intraflagellar transport 122
  Uniprot ID: Q9HBG6
  ENST ID: ENST00000507564
  CDS Start-End: 120-3824
gttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggcaagcgctttgcttctggatcagctgacaaaagcgttattatctggacatcaaaactggaaggcattctgaagtacacatcttggtctgtgatgtcttcattgcacctccatcttccatttctgggcctccacaaaacagtaagagtaacagccacagataaagcacctaaaggccaaggtgggaggattgattgcttgaggccaagcgttcaaaaccaacctggccaaaagcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaagagaggaacgtaatgacatcctggctgtggctgactggggacagaaagtttccttctaccagctgagtggaaaacagattggaaaggatcgggcactgaactttgacccctgctgcatcagctactttactaaaggcgagtacattttgctggggggttcagacaagcaagtatctcttttcaccaaggatggagtgcggcttgggactgttggggagcagaactcctgggtgtggacgtgtcaagcgaaaccggattccaactatgtggtggtcggctgccaggacggcaccatttccttctaccagcttattttcagcacagtccatgggctttacaaggaccgctatgcctacagggatagcatgactgacgtcattgtgcagcacctgatcactgagcagaaagttcggattaaatgcaaagagcttgtcaagaagattgccatctacagaaatcgattggctatccaactgccagagaaaatcctcatctatgagttgtattcagaggacttatcagacatgcattaccgggtaaaggagaagattatcaagaagtttgagtgcaacctcctggtggtgtgtgccaatcacatcatcctgtgccaggagaaacggctgcagtgcctgtccttcagcggagtgaaggagcgggagtggcagatggagtctctcattcgttacatcaaggtgatcggtggccctcctggaagagaaggcctcttagtggggctgaagaatggacagatcctgaagatcttcgtggacaatctctttgctatcgtcctgctgaagcaggccacagctgtgcgctgcttggacatgagtgcctcccgtaagaagctggccgtggtagatgaaaatgacacttgcctggtgtatgacatcgacaccaaggagctgctttttcaggaaccaaacgccaacagtgtagcttggaacacccagtgtgaggacatgctctgcttctcgggaggaggctacctcaacatcaaagccagcaccttccctgtgcaccggcagaagctgcagggctttgtggtcggctacaatggctccaagatcttctgcctccatgtcttctccatttctgccgtggaggtgccgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggccttcatcagagtacaagacctccgatatttagagctcatcagcagcattgaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgctgtgcgctacctacctcaagaagctggacagccctggctatgctgctgagacctacctgaagatgggtgacctcaagtccctggtgcagctgcacgtggagacccagcgctgggatgaggcctttgctttgggtgagaagcatcctgagtttaaggatgacatctacatgccgtatgctcagtggctagcagagaacgatcgctttgaggaagcccagaaagcgttccacaaggctgggcgacagagagaagcggtccaggtgctggagcagctcacaaacaatgccgtggcggagagcaggtttaatgatgctgcctattattactggatgctgtccatgcagtgcctcgatatagctcaagcagatcctgcccagaaggacacaatgcttggcaagttctaccacttccagcgtttggcagagctgtaccatggttaccatgccatccatcgccacacggaagatccgttcagtgtccatcgtcctgaaactcttttcaacatctccaggttcctgctgcacagcctgcccaaggacaccccctcgggcatctctaaagtgaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatga

SEQ ID NO: 144250 - DNA, 350 bp, Homo sapiens
  Payload ID: 8503
  Gene Symbol: IFT122
  Gene Name: intraflagellar transport 122
  ENST ID: ENST00000509195
  CDS Start-End: 1-139
tataaatgacatcgcatttaagcctgatggaactcaactgattttggctgccggaagcagattactggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcagctggacaaatgatggtcagtacctggcgctggggatgttcaatgggatcatcagcatacg

SEQ ID NO: 144251 - DNA, 469 bp, Homo sapiens
  Payload ID: 8503
  Gene Symbol: IFT122
  Gene Name: intraflagellar transport 122
  ENST ID: ENST00000502304
  CDS Start-End: 1-208
tataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatgtagagacggggtttcaccgtgttggccaggatggtctcgatctcctgacctcgtgatccacccgcctcagccctccaaagtgctgggattacaggcaagcgctttgcttctggatcagctgacaaaagcgttattatctggacatcaaaactggaaggcattctgaagtacacgcacaatgatgctatacaatgtgtctcctacaatcctattactcatcaactggcatcttgttcctccagtgactttgggttgtggtctcctgaacagaagtctgtctccaaacacaaatcaagcagcaagatcatctgctgcag

SEQ ID NO: 144252 - DNA, 445 bp, Homo sapiens
  Payload ID: 8503
  Gene Symbol: IFT122
  Gene Name: intraflagellar transport 122
  ENST ID: ENST00000502456
  CDS Start-End: 1-202
tataaatgacatcgcatttaagcctgatggaactcaactgattttggctgccggaagcagattactggtttatgacacctctgatggcaccttacttcagcccctcaagggacacaaagacactgtgtactgtgtggcatatgcgaaggatggaaatgaaagctcttcagtagcttgtttgggtcatgcagctggtcagtgagatctctaggaattctgacccagagactctgagcccaaagcttatgcttttcatcaccatcacctgctacctaccaggatgagggaggagtgatggaaatagcaagcgctttgcttctggatcagctgacaaaagcgttattatctggacatcaaaactggaaggcattctgaagtacacggttgtggtctcctgaacagaagtctgtctccaaacacaaatcaagcagcaagatcatctgct

SEQ ID NO: 144253 - DNA, 590 bp, Homo sapiens
  Payload ID: 8503
  Gene Symbol: IFT122
  Gene Name: intraflagellar transport 122
  ENST ID: ENST00000507221
  CDS Start-End: 76-590
atgcatctggttctttccatggctctgaaaacagtcttctttttttcccttgatgaaatcctgcagtccgctcccatgtaccagtacctggataggaaactgttcaaggaagcctaccagattgcttgcttgggtgtcacagacactgattggcgtgaactggccatggaagcgctagaaggtttagattttgaaacagcaaagaaggagaggaagaagcggggagagaccaacaatgacctgtttctggcagatgtgttttcctaccaggggaagttccatgaggccgccaaactgtacaagaggagtgggcacgagaacctcgcgcttgaaatgtacaccgacctctgcatgtttgagtatgccaaggatttccttggatctggagaccccaaagaaacaaagatgctaatcaccaaacaggctgactgggccagaaatatcaaggagcccaaagccgccgtggagatgtacatctcagcaggagagcacgtcaaggccatcgagatctgtggtgaccatggctgggttgacatgttgatcgacatcgcccgcaaactggacaaggctgagcgcgagcccctgctgct

SEQ ID NO: 144254 - DNA, 2987 bp, Homo sapiens
  Payload ID: 8504
  Gene Symbol: IFT140
  Gene Name: intraflagellar transport 140
  Uniprot ID: Q96RY7
  ENST ID: ENST00000361339
  CDS Start-End: 500-2470
gtcccagaggagaggccagggatgccgggtgcgggacagatccctcgtctcgcctgttgcttttaagcctggtggcccccggggcctggaggctggtactgagcgactattgcctgccctggggacttcacaccccccagccatccagttgcccccaggaccataggtacccccaggaccataggaaccacaagcctccccccgcccgtgtgttccaggcctgcccccgccacgggaatgctgccctcaaaaggggggcagatatcacaggattgctgggaaggggagagacccgtgtgcctggagggagcaagttcacccagacctgcagggccagggacctgtacttggaggacctcggggccagggacctgtacttggagggccttggggccagggacctgtacttggaggacctcggggccagggacctgtacttggaggacctcgaggccaggtcattcttaggtggcaagaaggtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaatttttttgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgaga

SEQ ID NO: 144255 - DNA, 4023 bp, Homo sapiens
  Payload ID: 8504
  Gene Symbol: IFT140
  Gene Name: intraflagellar transport 140
  ENST ID: ENST00000397417
  CDS Start-End: 62-682
aacgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctcctggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaatttttttgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctg

SEQ ID NO: 144256 - DNA, 5270 bp, Homo sapiens
  Payload ID: 8504
  Gene Symbol: IFT140
  Gene Name: intraflagellar transport 140
  Uniprot ID: Q96RY7
  ENST ID: ENST00000426508
  CDS Start-End: 365-4753
agacagccaataggccagggcccgtgctgtgattggccgcagcagtgttgacggatacgtgagaagaaaacggcgtggtagctcggagtgtggaatcgggcgcgaacctgagttctgagaagtgtggaagcacgtctgaggcaagcggaataacctggcccccgacgctcgggcctcggagctgcacgtgcgtgcccgatcgccttcggctctttccggccgctcggggcgcttcgggagtcctcggggccgcctcgctcaccttcggctatttccgcgttcctggcgcgccgttgtcccggcaacgcgcggcggctcagcggcctggcagaggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctggggacaggcttggtgtcttgctcttgtggaggttggaccaaaggggccgagtgcaagggacgcctctgctgaaacacgagtatgggaaacacctcacgcactgcatcttccggctcccccctcctggcgaggacctggttcagttggcaaaggcagctgtgagcggtgatgagaaagccctggacatgtttaactggaagaagagcagttctggaagtttgctgaagatggggtctcacgaggggctgttgttctttgtcagtctgatggacgggacagtgcactatgtggatgagaagggcaagaccactcaggtggtgtccgcagacagcacgattcagatgctgttctacatggagaagagggaggcactggtggtggtcacagagaacctccggctgtccctgtacacggtgcctcctgagggcaaagcagaagaagtgatgaaggtcaagctgagcgggaaaaccggccgccgggcagacatcgctttgattgaaggcagccttctcgtgatggccgtcggggaggctgccctcagattctgggacatagaacgaggagagaattatatactgagtccagatgagaagtttggctttgagaaaggagagaatatgaactgtgtgtgttactgtaaagtcaaaggtcttctggccgctggtaccgacagagggcgagtagccatgtggaggaaagtaccagacttcctgggcagccccggggcagagggcaaggacaggtgggcccttcagacccctaccgagctccaaggaaacatcacgcaaatccagtggggttccaggaagaacctgctggcagtgaacagcgtcatctccgtggccatcctcagcgagcgggccatgtcgtcacacttccaccagcaagtggccgccatgcaggtctccccgagtctgctgaatgtgtgcttcctgtccacgggggtcgcacacagcctgcgcaccgacatgcacatcagtggagtgtttgccaccaaggatgctgtcgcagtctggaacggaaggcaggtggcgatcttcgagctttctggagccgcgatacggagtgcagggaccttcttgtgtgagacgcctgtgttagcaatgcatgaagaaaacgtttacacggtggagtcaaaccgagttcaagttcgaacctggcaggggactgtcaaacaactcctccttttctcggagactgaggggaatccctgcttcttggacatctgtgggaatttcctggttgtagggacagacttggctcactttaaaagctttgatctttcccgaagagaggccaaagcacactgtagctgcaggagcctggcggagctggtccctggggtggggggcatcgcttctctgcggtgcagcagcagcgggagcaccatcagcatcctccccagcaaggctgacaacagccctgattccaaaatctgcttctacgatgttgaaatggacacagtgaccgtctttgacttcaagactggacaaattgatcggagagagacgctgtcctttaatgagcaagagactaataagagccacctctttgtggatgagggactgaaaaattatgttcccgtgaaccacttctgggaccagagtgagccccggctgtttgtatgcgaagccgtgcaggagacgccgcgctcccagcctcagtctgcaaacgggcagccccaagatgggcgcgctggccctgcggcagatgttttgatcctgtccttcttcatttccgaagagcacggcttcctgcttcatgagagcttcccccggcctgccacctcccacagtctcctggggatggaagtgccttattactacttcacaagaaagcccgaagaagcagacagagaagacgaggtggagcctgggtgccaccacatccctcagatggtgtccaggagacccctgcgagactttgtggggctggaggactgcgacaaggccacccgggacgccatgctccacttcagcttctttgtcaccataggagacatggacgaagccttcaaatccatcaagctcatcaaaagtgaggccgtctgggagaacatggcgcgcatgtgcgtgaagacccagcggctggacgtggccaaggtgtgcctggggaacatgggccatgcccgcggggcccgagcgctgcgtgaggcggagcaggagccggagctagaggcccgcgtggccgtgctggccacgcagctgggcatgctggaggacgccgagcagctgtacaggaagtgcaagcgccacgacctcctgaacaagttctaccaggctgcgggccggtggcaggaggccctccaggtagccgagcaccacgatcgcgtgcacctgcgcagcacctaccaccgctatgccgggcacctggaggccagcgccgactgcagccgggccctcagttactacgagaagtcggacacgcaccgcttcgaggtgcccaggatgctgtcggaggacctgccgtccctggagctctacgtgaataaaatgaaggataagaccctgtggcggtggtgggcgcagtacctggagagccagggcgagatggacgccgcgctgcactactacgagctggcccgggaccacttctccctggtccgcatccactgcttccagggcaatgtccagaaggctgcgcaaatagccaacgagacaggaaacctggcggcctcctaccacctcgcccgccagtacgagagccaggaggaggtcgggcaggcggtgcacttctacacccgggcacaggccttcaagaatgccatccgcctgtgcaaggagaacggcctggacgaccagctcatgaacttggccctgctgagctcccccgaggacatgatcgaggcggcccgatactacgaggagaagggcgtgcagatggacagggcggtcatgctgtaccacaaggctggccacttctccaaggccctggagctggcctttgccacccagcagtttgtggccctacagctcatagcagaggacctggatgagacgtcagaccctgcgctcctggcccgctgctccgacttcttcatcgagcacagtcagtacgagagggcggtagagctgctgctggctgccaggaagtatcaggaagccctgcagctgtgcctggggcagaacatgagcatcaccgaggagatggcggaaaagatgaccgtggccaaggactcctcggacctgcctgaggagtcgcggcgggagctgctggagcagatagcagactgctgcatgcgccagggcagctaccacctggccaccaagaagtacacgcaggccggcaacaagctgaaggccatgagggcgctgctcaaatccggagacacggagaaaatcacgttcttcgcgagcgtgtccaggcagaaggaaatctacatcatggctgctaactacctgcagtccctggactggcggaaggagccggagatcatgaagaacatcatcggcttctacaccaaggggcgggccctggacctcctggctggcttttatgacgcttgtgcccaggtggagattgatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggcctacagattcctggaggagatgcggcggcggcttcccttggccaacatgtcctactacgtgagcccgcaggccgtggacgccgtgcaccgggggctgggtctcccactgccacgcaccgtccccgagcaggtccgccacaacagcatggaggacgccagggagctggacgaggaggtggtggaagaggcagatgacgacccctgaggggcctgggccccaggaccagcgtgctgctgcagaaaggcatcttctggaatttttttgtcagctgtggcaaagccagcatttttgctgggaaaaaacatgtctgtgttggaatacgcgacagagctgggcgagaacgcagcggcccgggccggcggagggtgtgacccgtctgcaccttgctctgtcccacctgcctctgggtgcccggcagctccactagatttttggattcattcctttgaagggagtcgggttcacccttccatcgtattctcccaactacacattgtaaagcctgagaaacttctagaacctcaggaagctgcagctggagggctggggcacctgcccccctgctccccacacatcatatcctccccatactcctgcagggcccacggctcctgagcaacagctgggacacccgggccttggcggctgcaccccctgctaggctctgcccaccggccaccaacactcctgtaattccaataaagcagtttattttctgaga

SEQ ID NO: 144257 - DNA, 643 bp, Homo sapiens
  Payload ID: 8504
  Gene Symbol: IFT140
  Gene Name: intraflagellar transport 140
  ENST ID: ENST00000569646
  CDS Start-End: 282-643
gaggtgagtggccttagggctagggcggccgacccaggtccttaggagccaggccggggtttggggccgaggatgtgaccggtggcgggcgtcgggaccctcccgtctcctcccacgatcccggcgccgccgagtccccgcggcccctcgcgagtcccatcgaggctggggcgggcttggcgcggggtccaggtcgctcgtcggactatggctgtcgcccccgcccggcctcgaatcgcggctgattccggtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccagtggaaactgcctgctgtctgg

SEQ ID NO: 144258 - DNA, 452 bp, Homo sapiens
  Payload ID: 8504
  Gene Symbol: IFT140
  Gene Name: intraflagellar transport 140
  ENST ID: ENST00000569812
  CDS Start-End: 112-452
atgggcttaacagattctttcccaaaagctggtttgatggaggcacttgtagaggctctggagacgctggacgcctgaaagtttcagcgctgaggaggcctgagttccgtcatggccctctattatgaccaccagatagaagccccggatgcagcagggtcaccctcatttatcagctggcaccctgtccatccattcttggcagttgcttacatcagcacaacctcaacaggcagcgtggatatttacctggagcaaggggagtgcgtgccagatacacacgtcgagaggccgttccgggttgcttccctgtgctggcacccgacgcggctggtgctggctgtgggctgggagactggagaagtgacggtgtttaacaagcaggacaaggagcagcacacgatgcccctgacacacacagccgacatcaccgtgctccgttggagccccag

SEQ ID NO: 144259 - DNA, 414 bp, Homo sapiens
  Payload ID: 8504
  Gene Symbol: IFT140
  Gene Name: intraflagellar transport 140
  ENST ID: ENST00000568837
  CDS Start-End: 1-378
gatgaataccagaactacgacaaagcccacggggcgctgaccgaggcctacaagtgcctggccaaggccaaggccaagagccccctggaccaggagaccaggctggcgcagctgcagagcaggatggcactggtgaagaggttcatccaggcccgcaggacgtacacagaggaccccaaggagtccatcaagcagtgtgagctgctcctggaggaaccagacctggacagcaccatccgcatcggggacgtctatggcttcctggtggagcactacgtgcggaaggaggaataccagacggtgaggcctgagtgctgctcactagcagcatcccgccacacaaggctcctgaaacgaaggcttaacggctcaaactgaggctgtgtgtggcggctcactcctgtaatcccagca

SEQ ID NO: 144260 - DNA, 5415 bp, Homo sapiens
  Payload ID: 8505
  Gene Symbol: IFT172
  Gene Name: intraflagellar transport 172
  Uniprot ID: Q9UG01
  ENST ID: ENST00000260570
  CDS Start-End: 105-5354
gtcgcataagcgtcagtgcctgtcgctgcggctgcgtggcgggttgtccaggtaaccacgggagttgtcgctgtctaggagcatctgaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataattgaga

SEQ ID NO: 144261 - DNA, 2207 bp, Homo sapiens
  Payload ID: 8505
  Gene Symbol: IFT172
  Gene Name: intraflagellar transport 172
  Uniprot ID: Q9UG01
  ENST ID: ENST00000359466
  CDS Start-End: 121-1719
cgcgtgttgcgctccggtcgcataagcgtcagtgcctgtcgctgcggctgcgtggcgggttgtccaggtaaccacgggagttgtcgctgtctaggagcatctgaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtgtgagaagagctactaaggccttaggcattggctggcccacagagggtgtgagacaagctgccaccagggactgagggaggcaggatggagcacattgtctttgctgtgtcatcaacatggcagaaggcacagaagaatcaacattctctgtagctgataccaaaactgatagcaaaacccatcctttattacctctttttttttttttttggagacagtgtctcactctgtcacccaggctggagtgcagtggtacaatctgggctcactgcaacttctgcctcccgggttcaagtgattctcctgcctcagcctccccagtagctgggactacaggcacgtgccaccacacctagataatttttgtatttttagtagagatgggttttcaccatgttggccaggctggtctcgaactcctgacctcctggcctcaggtgatctgcctgcctctgcctctcaaagtgctgggattacaggtgttgagccatgcgcccagcaatcctgtatgacctcagaggtgattgtattatggcaacaaagtcaagaagggagtttggaa

SEQ ID NO: 144262 - DNA, 569 bp, Homo sapiens
  Payload ID: 8505
  Gene Symbol: IFT172
  Gene Name: intraflagellar transport 172
  ENST ID: ENST00000420854
  CDS Start-End: 1-489
aacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccgtgaaagtagaagcaaaatagaaagaaaaggctgtgactgcatcccccaatccaaggaggattcgtggctaaaagctggaggct

SEQ ID NO: 144263 - DNA, 760 bp, Homo sapiens
  Payload ID: 8505
  Gene Symbol: IFT172
  Gene Name: intraflagellar transport 172
  ENST ID: ENST00000450564
  CDS Start-End: 1-291
gctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacag

SEQ ID NO: 144264 - DNA, 690 bp, Homo sapiens
  Payload ID: 8505
  Gene Symbol: IFT172
  Gene Name: intraflagellar transport 172
  ENST ID: ENST00000443889
  CDS Start-End: 1-589
ctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggtagcaggaatctatggagtgcctgctggatgatagagccagaacctctgaaggctataaaagtggatataagacagagccctgacagccaaaagttaggggaattagaccaataaatggctcaattactatca

SEQ ID NO: 144265 - DNA, 1982 bp, Homo sapiens
  Payload ID: 8505
  Gene Symbol: IFT172
  Gene Name: intraflagellar transport 172
  ENST ID: ENST00000416524
  CDS Start-End: 284-1819
acgtgtgaccttgcgacgcgtgttgcgctccggtcgcataagcgtcagtgcctgtcgctgcggctgcgtggcgggttgtccaggtaaccacgggagttgtcgctgtctaggagcatctgaaagacaggtgtgcgtcatgcacttgaagcacctgaggaccctgctgagccctcagcccaaactcctttgcctggcttcaaagacttcctgagctggcctgtttttcctgccttaccccgtctattctactatttataaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtgtgagaagagctactaaggccttaggcattggctggcccacagagggtgtgagacaagctgccaccagggactgagggaggcaggatggagcacattgtctttgctgtgtcatcaacatggcagaaggcacagaagaatcaacattctctgtagctgataccaaaactgatagcaaaacccatcctttattacctctttttttttttttttggagacagtgtctcactctgtcaccca

SEQ ID NO: 144266 - DNA, 1723 bp, Homo sapiens
  Payload ID: 8505
  Gene Symbol: IFT172
  Gene Name: intraflagellar transport 172
  ENST ID: ENST00000509128
  CDS Start-End: 1-973
gcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctggctgtgctgtctccctcctctagtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 144267 - DNA, 974 bp, Homo sapiens
  Payload ID: 8506
  Gene Symbol: IFT20
  Gene Name: intraflagellar transport 20
  Uniprot ID: Q8IY31
  ENST ID: ENST00000357896
  CDS Start-End: 133-579
ggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaagagtcttgctgtgtcacccaggctggagtgcactggtgcaatctcggctcactgcaagctctgcctctcagattcaagcgattctcccacctcaccctcccgagtaggtgggactacaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatg

SEQ ID NO: 144268 - DNA, 825 bp, Homo sapiens
  Payload ID: 8506
  Gene Symbol: IFT20
  Gene Name: intraflagellar transport 20
  Uniprot ID: Q8IY31
  ENST ID: ENST00000395418
  CDS Start-End: 104-502
gccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaa

SEQ ID NO: 144269 - DNA, 557 bp, Homo sapiens
  Payload ID: 8506
  Gene Symbol: IFT20
  Gene Name: intraflagellar transport 20
  ENST ID: ENST00000577498
  CDS Start-End: 301-557
agcggccgtggcaggctggctgggtaccggctgtcgctgacccaggagaagctgcctgtctacatcagcctgggctgcagcgcgctgccgccgcggggccggcaggaagagaatgacccaactttgattcccaattcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatca

SEQ ID NO: 144270 - DNA, 852 bp, Homo sapiens
  Payload ID: 8506
  Gene Symbol: IFT20
  Gene Name: intraflagellar transport 20
  Uniprot ID: Q8IY31
  ENST ID: ENST00000585313
  CDS Start-End: 139-537
ccgtggcaggctggctgggtaccggctgtcgctgacccaggagaagctgcctgtctacatcagcctgggctgcagcgcgctgccgccgcggggccggcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttg

SEQ ID NO: 144271 - DNA, 787 bp, Homo sapiens
  Payload ID: 8506
  Gene Symbol: IFT20
  Gene Name: intraflagellar transport 20
  Uniprot ID: Q8IY31
  ENST ID: ENST00000579419
  CDS Start-End: 139-483
ccgtggcaggctggctgggtaccggctgtcgctgacccaggagaagctgcctgtctacatcagcctgggctgcagcgcgctgccgccgcggggccggcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatgg

SEQ ID NO: 144272 - DNA, 831 bp, Homo sapiens
  Payload ID: 8506
  Gene Symbol: IFT20
  Gene Name: intraflagellar transport 20
  ENST ID: ENST00000578985
  CDS Start-End: 263-661
gccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaa

SEQ ID NO: 144273 - DNA, 834 bp, Homo sapiens
  Payload ID: 8506
  Gene Symbol: IFT20
  Gene Name: intraflagellar transport 20
  ENST ID: ENST00000578122
  CDS Start-End: 258-683
ggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatggg

SEQ ID NO: 144274 - DNA, 611 bp, Homo sapiens
  Payload ID: 8506
  Gene Symbol: IFT20
  Gene Name: intraflagellar transport 20
  ENST ID: ENST00000578009
  CDS Start-End: 1-216
gacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatg

SEQ ID NO: 144275 - DNA, 1071 bp, Homo sapiens
  Payload ID: 8506
  Gene Symbol: IFT20
  Gene Name: intraflagellar transport 20
  Uniprot ID: Q8IY31
  ENST ID: ENST00000585089
  CDS Start-End: 272-748
gtggcagcggccgtggcaggctggctgggtaccggctgtcgctgacccaggagaagctgcctgtctacatcagcctgggctgcagcgcgctgccgccgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggccatcggtgctcggaacttgctcaaatctatagcaaagcagagagaagctcaacagcagcaacttcaagccctaatagcagaaaagaaaatgcagctagaaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaa

SEQ ID NO: 144276 - DNA, 774 bp, Homo sapiens
  Payload ID: 8506
  Gene Symbol: IFT20
  Gene Name: intraflagellar transport 20
  ENST ID: ENST00000588477
  CDS Start-End: 153-377
aggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgaagcagggctacactttgatgaactgaacaagctgagggtgttggacccagaggttacccagcagaccatagagctgaaggaagagtgcaaagactttgtggacaaaattggccagtttcagaaaatagttggtggtttaattgagcttgttgatcaacttgcaaaagaagcagaaaatgaaaagatgaaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatggc

SEQ ID NO: 144277 - DNA, 1130 bp, Homo sapiens
  Payload ID: 8507
  Gene Symbol: IFT22
  Gene Name: intraflagellar transport 22
  Uniprot ID: Q9H7X7
  ENST ID: ENST00000315322
  CDS Start-End: 95-652
tccgtcgccatggaaacgaaagcggccaagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattccca

SEQ ID NO: 144278 - DNA, 933 bp, Homo sapiens
  Payload ID: 8507
  Gene Symbol: IFT22
  Gene Name: intraflagellar transport 22
  ENST ID: ENST00000430911
  CDS Start-End: 89-202
gccatggaaacgaaagcggccaagtagagctccgtcctgacgcgccgcctcccgtgggctccggccggctaagccgcggcggacaactatgctgaaagccaagatcctcttcgtggggccttgcgagcaaagacctttatttgcactcattttcacagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatgga

SEQ ID NO: 144279 - DNA, 875 bp, Homo sapiens
  Payload ID: 8507
  Gene Symbol: IFT22
  Gene Name: intraflagellar transport 22
  Uniprot ID: Q9H7X7
  ENST ID: ENST00000437644
  CDS Start-End: 69-536
caagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaa

SEQ ID NO: 144280 - DNA, 1785 bp, Homo sapiens
  Payload ID: 8507
  Gene Symbol: IFT22
  Gene Name: intraflagellar transport 22
  Uniprot ID: Q9H7X7
  ENST ID: ENST00000422177
  CDS Start-End: 86-643
atggaaacgaaagcggccaagtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaaaagccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaa

SEQ ID NO: 144281 - DNA, 1657 bp, Homo sapiens
  Payload ID: 8507
  Gene Symbol: IFT22
  Gene Name: intraflagellar transport 22
  Uniprot ID: Q9H7X7
  ENST ID: ENST00000517481
  CDS Start-End: 372-698
aagtagagctccgtcctgacgcgccgcctcccgtgggctccggccggctaagccgcggcggacaactatgctgaaagccaagatcctcttcgtggggccttgcgagaccttgattccaaccactgcccggaggaggtagtggaggcgagcccggtgttaatgagccccgaaggcccaagagtggaaaaactgttttggccaactttctgacagaatcttctgacatcactgaatacagcccaacccaaggagtgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaaaagccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcccgggagacagaggttgcagtgagccaagattgcgccactgtactccagcttgggcaacagagcaagactccatctc

SEQ ID NO: 144282 - DNA, 917 bp, Homo sapiens
  Payload ID: 8507
  Gene Symbol: IFT22
  Gene Name: intraflagellar transport 22
  Uniprot ID: Q9H7X7
  ENST ID: ENST00000498704
  CDS Start-End: 210-536
gtcctgacgcgccgcctcccgtgggctccggccggctaagccgcggcggacaactatgctgaaagccaagatcctcttcgtggggccttgcgaggatcctagaatttgagaacccgcatgttaccagcaacaacaaaggcacgggctgtgaattcgagctatgggactgtggtggcgatgctaagtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattca

SEQ ID NO: 144283 - DNA, 2272 bp, Homo sapiens
  Payload ID: 8507
  Gene Symbol: IFT22
  Gene Name: intraflagellar transport 22
  Uniprot ID: Q9H7X7
  ENST ID: ENST00000621899
  CDS Start-End: 179-505
gtcggccctgcgggcctctctccgtcgccatggaaacgaaagcggccaagtagagctccgtcctgacgcgccgcctcccgtgggctccggccggctaagccgcggcggacaactatgctgaaagccaagatcctcttcgtggggccttgcgaggtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaaaagccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcccgggagacagaggttgcagtgagccaagattgcgccactgtactccagcttgggcaacagagcaagactccatctcaaaaaaaaaagagttctagcccaggagcggtggctcacacttgtaatcccagcactttgggatgctaaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagca

SEQ ID NO: 144284 - DNA, 1113 bp, Homo sapiens
  Payload ID: 8508
  Gene Symbol: IFT27
  Gene Name: intraflagellar transport 27
  Uniprot ID: Q9BW83
  ENST ID: ENST00000340630
  CDS Start-End: 447-1004
aatcgagggtcagcgaggaggaggaggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcgaagcagca

SEQ ID NO: 144285 - DNA, 531 bp, Homo sapiens
  Payload ID: 8508
  Gene Symbol: IFT27
  Gene Name: intraflagellar transport 27
  ENST ID: ENST00000430701
  CDS Start-End: 183-531
ggcggggcaggtgggctatggttgcttggagagtgcatccggcccggtacttgtgatcggaggagagccggatcgtccttccttgaaccctctgggccagcccagggcccgaagcccacccactcgcgtctctagcagccgctcttgtcctctgggtacggctcgcgggagtgttggttaccatggtgaagctggcagccaaatgcatcctggcagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccag

SEQ ID NO: 144286 - DNA, 946 bp, Homo sapiens
  Payload ID: 8508
  Gene Symbol: IFT27
  Gene Name: intraflagellar transport 27
  ENST ID: ENST00000417951
  CDS Start-End: 397-946
tgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcagttcctgtggataaaaggcttagccgtgcagaagtgtgctctggctgttgtgaggtttgcagatcagtctcatggacctgtgccctgcccgcggcctcagaacaagttcccgtgagaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggcc

SEQ ID NO: 144287 - DNA, 1095 bp, Homo sapiens
  Payload ID: 8508
  Gene Symbol: IFT27
  Gene Name: intraflagellar transport 27
  Uniprot ID: Q9BW83
  ENST ID: ENST00000433985
  CDS Start-End: 427-987
gaggaggaggcggggcaggtgggctatggttgcttggagagtgcatccggcccggtacttgtgatcggaggagagccggatcgtccttccttgaaccctctgggtagggctgtgctgaggggctgggcggggagcacaggccgtgtccgctcgcttgcaccttttcagactgccgtgtcaggcctcgagccgggcccacctggagccctcccctgcccacccgcccccagcgcccgatatccgcccccggcccagaagggccgggctcggtcatccccagtcccgtcgcggccactgacccttgagatcagccctcccctccccaccttcccgtcccaggccagcccagggcccgaagcccacccactcgcgtctctagcagccgctcttgtcctctgggtacggctcgcgggagtgttggttaccatggtgaagctggcagccaaatgcatcctggcaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtcgaagcagc

SEQ ID NO: 144288 - DNA, 813 bp, Homo sapiens
  Payload ID: 8508
  Gene Symbol: IFT27
  Gene Name: intraflagellar transport 27
  ENST ID: ENST00000440696
  CDS Start-End: 662-813
gaggagagggagataaagccagtaggtgagagatgagcttggaggaggtgactgctattgcagatagaattggtggagaggcccctgggaagaagaatccttgggtcacagacaggtattctgcgatggagatggagcatagcatttggaaagagatttcagaatgatgaacacagcctcagacttcttgcttcccacaaatgcagagacccttccaccccccacgccccacacaaaaaagtattcaggtggaagctgtcaacccaggttgggtcagttggacaggtgactctgcctgtcagtgccagtcacacttctttaccttcaagacttcaaagtaaattccagtttggaagtgacagcttttccccatagggcgtgtttcagtggaagagcgtcagttccgtttccagggccccaaagccctctgtaagttctgttaccttctgggtcagttcctgtggataaaaggcttagccgtgcagaagtgtgctctggctgttgtgaggtttgcagatcagtctcatggacctgtgccctgcccgcggcctcagaacaagttcccgtgagaggagacccagcagtgggcaagaccgccctggcacagatcttccgcagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgac

SEQ ID NO: 144289 - DNA, 660 bp, Homo sapiens
  Payload ID: 8508
  Gene Symbol: IFT27
  Gene Name: intraflagellar transport 27
  ENST ID: ENST00000415653
  CDS Start-End: 1-388
cagtgatggagcccatttccagaaaagctacaccctgacaacaggaatggatttggtggtgaagacagtgccagttcctgacacgggagacagtgtggaactcttcatttttgactctgctggcaaggagctgttttcggaaatgctggataaattgtgggagagtcccaatgtcttatgtctcgtctatgatgtgaccaatgaagaatccttcaacaactgcagcaagtggctggagaaggctcggtcacaggctccaggcatctctctcccaggtgttttagttgggaacaagacagacctggccggcagacgagcagtggactcagctgaggcccgggcatgggcgctgggccagggcctggaatgttttgaaacatccgtgtgaccatcctgcctacccaaaggaggtccctacaaacaagtgcaagaacaatccgcgctgatcactgccctcccagaaagagatggaaaacttcgaagcccctttccactgccttgccaagcagttccaccagctgtaccgggagaaggtggaggttttccgggccctggcatgacgagctggagcagatcgtgctgcacaaccggagaagacagaattacctctgctcttttaatatataatgatggctttaaataaaattaggagaaaatgtc

SEQ ID NO: 144290 - DNA, 816 bp, Homo sapiens
  Payload ID: 8509
  Gene Symbol: IFT43
  Gene Name: intraflagellar transport 43
  Uniprot ID: Q96FT9
  ENST ID: ENST00000238628
  CDS Start-End: 6-647
cggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaacggtacccaaacaggcaaacaacagctggatctgaacgcatgctatcacaaaacgcatcacagagatttggggctggcttcattggaagaggcagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctc

SEQ ID NO: 144291 - DNA, 833 bp, Homo sapiens
  Payload ID: 8509
  Gene Symbol: IFT43
  Gene Name: intraflagellar transport 43
  Uniprot ID: Q96FT9
  ENST ID: ENST00000314067
  CDS Start-End: 35-661
ggtttccaggaagtgacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccacattggataattcaattgcaataaattgcttattctgtgccatctcctc

SEQ ID NO: 144292 - DNA, 1014 bp, Homo sapiens
  Payload ID: 8509
  Gene Symbol: IFT43
  Gene Name: intraflagellar transport 43
  Uniprot ID: Q96FT9
  ENST ID: ENST00000542766
  CDS Start-End: 18-644
gtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggaagaagactttgttttgcaggtggcagcccctcccagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagctttctcttcttggaaaatgtatcacaagtgaaggagaacagcttttaaaccagctgataggaactcagaactcgcggccttgttgcggagcatgtgggagagttcgattcaggcggagaaggagtgggcactcctactgaaagctgttcacttctcgggaggtttcaaacagttgcctgctggggttctggggcggggcctcccttcccgtgggtgctctgggccctttgtgaccttagtgacgcagcactgccacctgcatcataggcttccaggcagctgcagcggagggaggaggcggcgggagggataa

SEQ ID NO: 144293 - DNA, 848 bp, Homo sapiens
  Payload ID: 8509
  Gene Symbol: IFT43
  Gene Name: intraflagellar transport 43
  Uniprot ID: Q96FT9
  ENST ID: ENST00000556742
  CDS Start-End: 4-345
gagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagagtacgtttccagtattcttattcttatggtatcctatgttgatcttggtcaacagtgcagtcttggtggtcatgatctgttccacctatgttgaacactgtgttagaagtctggggctagaattattgatgcctgctgaatccaaggtttggttaatcccgcttcctcaactgaaggtctggaccctggcattgatgcccatgtcctatctcccactgtgtggttttagaattatatgtccaggtatcagggtactggcccatgccttctgcattattgatatagatgggcagaagcaataccagcttctaagccttgccttctcataagacttatatcagaaaagaaagaagttttctagataaaggtgctgtgaaggtagggccacccagtttcctactcccaggggcggaagctgcattcatgtcatagcctctgtgatgctgtcctctggaatagtgcatcgcacagcctgtgcaaccacacacggcacacccagtggcctaattaggtttgactaagttgacagagaaaaacaggttcagggacattttcatctaggagaaagaatggatacaataaacatttgggatgttc

SEQ ID NO: 144294 - DNA, 460 bp, Homo sapiens
  Payload ID: 8509
  Gene Symbol: IFT43
  Gene Name: intraflagellar transport 43
  ENST ID: ENST00000555370
  CDS Start-End: 6-104
cggagatggaggatttgctcgacttggacgaggagcttcgctacagcttggctacctccagccccgagtgcgaacttccccagaacagatcgatcacagggtgataggggagccccggccggggtcgcactcgctcccatcctagagtttttcctttgggacacctcgtcgcagaagttcctgcaaaagccgcactgttttatgcatggaagggagagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggaggta

SEQ ID NO: 144295 - DNA, 1819 bp, Homo sapiens
  Payload ID: 8510
  Gene Symbol: IFT46
  Gene Name: intraflagellar transport 46
  Uniprot ID: Q9NQC8
  ENST ID: ENST00000264020
  CDS Start-End: 379-1446
gtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggtcctaagggagggcatgccacaggctccaggccacagaggcaaagacatggaccctgttccacctgcccctgcaagtctcaagtgccaccagaccccttctcatgtacttgagagggtgggatggtacagagagagccagaagcacagaaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaa

SEQ ID NO: 144296 - DNA, 1722 bp, Homo sapiens
  Payload ID: 8510
  Gene Symbol: IFT46
  Gene Name: intraflagellar transport 46
  Uniprot ID: Q9NQC8
  ENST ID: ENST00000264021
  CDS Start-End: 420-1334
tagacaaacaggcgacttggccgcccagagaggctttatccgtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgccattctagacatccctgtctacaagagtcggatccagtccctccatctgctcttttccctctactcagaattcaagaactcacagcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaattgttttctttcattcgtaaagttagtgagtaaagattttataaatcaaatgctctattatattg

SEQ ID NO: 144297 - DNA, 1566 bp, Homo sapiens
  Payload ID: 8510
  Gene Symbol: IFT46
  Gene Name: intraflagellar transport 46
  ENST ID: ENST00000530872
  CDS Start-End: 261-1154
cgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggtcctaagggagggcatgccacaggctccaggccacagaggcaaagacatggaccctgttccacctgcccctgcaagtctcaagtgccaccagaccccttctcatgtacttgagagggtgggatggtacagagagagccagaagcacagaaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcgactgtgcactacaccaggcccatgcccgacattgacacgctgatgcaggaatggtccccggagtttgaagagcttttgggcaaggtaagcctgcccacggcagagattgattgcagcctggcagagtacattgacatgatctgtgcattttaaagctctcgctgaaggcaagaaagcattcactccttcatccaattccacctcccaagctggagacatggagacattaaccttcagctgagacacttcccaagctgctgtttcaaggctgagctggcccctctgccccagctgagatggacagatcgttgtcagctacttgatgtccttgcccatgccacagcttggctcaggggcagtgcatgtcctgctgccctctctgccagagggcacagaacatgtttgtttaatgaacctgcctgcctcagattgctgtccccggggagttaatgcatctacaccactgtggggatttgagttataagaattggaatttctgagatcccatggaggttagattgggaggaaagcttaaaagatgtcctttttgtgagagggatggaat

SEQ ID NO: 144298 - DNA, 774 bp, Homo sapiens
  Payload ID: 8510
  Gene Symbol: IFT46
  Gene Name: intraflagellar transport 46
  ENST ID: ENST00000534114
  CDS Start-End: 298-774
cgggcacgacgacagatggactggagtcagctccatcggatctccaggagaccgggcacaggaggccacactgctccccgagcccggagcaaaagcactctgccctagaccctcagggcggggctcctccggcccctgccccaggcccgccgacaaggagagacgaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggtcctaagggagggcatgccacaggctccaggccacagaggcaaagacatggaccctgttccacctgcccctgcaagtctcaagtgccaccagaccccttctcatgtacttgagagggtgggatggtacagagagagccagaagcacagaaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatccca

SEQ ID NO: 144299 - DNA, 776 bp, Homo sapiens
  Payload ID: 8510
  Gene Symbol: IFT46
  Gene Name: intraflagellar transport 46
  ENST ID: ENST00000534156
  CDS Start-End: 193-776
ctttattcccccaagaaacttaggtgggatcctatctgcaagataagggtgaaagtggagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccc

SEQ ID NO: 144300 - DNA, 830 bp, Homo sapiens
  Payload ID: 8510
  Gene Symbol: IFT46
  Gene Name: intraflagellar transport 46
  ENST ID: ENST00000528378
  CDS Start-End: 508-830
gattaacagaaggaccagaacctccggagacaggcccagcctgctgagcctaagcgccagggaaccggcgggacagcatcagttccgaggtccgcagcctgggacccgcaccaccaccacgaagttctcgcagagcaaaaacgccgggccgtctcaggggcaggtcccagcaaacgagggagtccagctggttggggggtggtgcggaagcgggcacgacgacagatggactggagtcagctccatcggatctccaggagaccgggcacaggaggccacactgctccccgagcccggagcaaaagcactctgccctagaccctcagggcggggctcctccggcccctgccccaggcccgccgacaaggagagacgaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatccc

SEQ ID NO: 144301 - DNA, 553 bp, Homo sapiens
  Payload ID: 8510
  Gene Symbol: IFT46
  Gene Name: intraflagellar transport 46
  ENST ID: ENST00000533918
  CDS Start-End: 369-553
acaggaggccacactgctccccgagcccggagcaaaagcactctgccctagaccctcagggcggggctcctccggcccctgccccaggcccgccgacaaggagagacgcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaagg

SEQ ID NO: 144302 - DNA, 1182 bp, Homo sapiens
  Payload ID: 8510
  Gene Symbol: IFT46
  Gene Name: intraflagellar transport 46
  ENST ID: ENST00000531939
  CDS Start-End: 594-1182
acaggctctcactctgttgcccgggctggagtgcagcagcatgaacactggacactgctcactgcagcctcgaactcctgggtttaagcagacctcctgcgtcagcctcccgagtagctgggaccacaggcgcatggcatcacacccagctaattttttttctttttttttttttgtagatgggatcttgccatattgtccagtctaggctcaaactcctgggctcaagtgatcctcctgcctccccttcccaaagtgttgggattataggcatgagccactgcccctggccagagtttatattatttatgtaatggcagataatttgaatagtataatgtctaacccaatgccttaagcacagtaatgtttagtaaatatatcttgaattgaactggcagagccatgactagaattcagtctcctgtctctttagccagatgttccaataaaccttgttttataaaatggttagagcataaaatattaaaaactaaaaaatacttgtttttaaaaatcattttaacaataatctaaaggaaaaactttttttctaaggacttcctcgttctgcccatcttcctaacaaggctatggctgataacagcagtgatgagtgtgaagaggaaaataacaaggagaagaagaagacctcacagttgacacctcaacggggctttagtgaaaatgaggatgacgatgatgatgatgatgattcatctgaaactgattctgattctgatgatgatgatgaagagcatggagcccctctggaaggggcctatgaccctgcagactatgagcatttgccagtttctgctgaaattaaggaactcttccagtacatcagtaggtacacacctcagttgattgacctggaccacaaactgaagcctttcattcctgattttatcccagctgtcggggatattgatgcattcttaaaggtcccacgtcctgatggaaagcctgacaaccttggcctattggtattggatgaaccttctacaaagcagtcagaccctacggtgctctcactctggttaacagagaattctaagcagcacaacatcacacaacatatgaaagtaaaaagcctagaagatgcagaaaagaatcccaaagccattgacacgtggattgagagcatctctgaattacaccgttctaagccccctgcga

SEQ ID NO: 144303 - DNA, 1757 bp, Homo sapiens
  Payload ID: 8511
  Gene Symbol: IFT52
  Gene Name: intraflagellar transport 52
  Uniprot ID: Q9Y366
  ENST ID: ENST00000373030
  CDS Start-End: 131-1444
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtgaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttataccctatgaaacagtcttgatttttttttctcaaccccagttctggatttgagtcttttatcaaagacataattaactct

SEQ ID NO: 144304 - DNA, 1599 bp, Homo sapiens
  Payload ID: 8511
  Gene Symbol: IFT52
  Gene Name: intraflagellar transport 52
  Uniprot ID: Q9Y366
  ENST ID: ENST00000373039
  CDS Start-End: 47-1360
ggccttggatacctggccgcgggatgctgggcggcgtcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtgaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttatacccta

SEQ ID NO: 144305 - DNA, 3203 bp, Homo sapiens
  Payload ID: 8512
  Gene Symbol: IFT57
  Gene Name: intraflagellar transport 57
  Uniprot ID: Q9NWB7
  ENST ID: ENST00000264538
  CDS Start-End: 249-1538
atgaggggcggggctgcttcccgaccaccatttccacagaggcagggcaagaagagggccacaggtgacgtcattcaggaaagccgccctgattggagggaaggaggcggagtctagtttccctggtgacggattgtccggtggtcgcctggtaaccggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgaggcaaaggagcgataccagcagggaaatggaggagtgacggaaagaaccagactcctctctgaggttatggaagaattagaaaaggtaaaacaagaaatggaagaaaagggcagcagcatgactgatggtgctcctttggtgaagattaaacagagcttaacaaaactgaagcaagaaactgtagagatggacattagaattggcattgtggaacacacactactccaatcaaagctgaaggagaagtccaacatgactaggaacatgcatgccacagttattccagaaccagcaacaggcttttattaaaacatactggttttcatgtttctgattagttgggttttttatatcaaactatatttcatgttgcatagatttcaaaacataattttatgttcaatgggtatttttttacatatacatactcacatattatatcatggtgattatgatggttaaagcctttacactgaatgtaatgtttaataaagaaattacaaattctcactttctaagaagctttcactaatcattacctatgttaaagctcccacctggtggctcatttttcatagcattccttgtgtaagccaaggtatatgacctgcgttttctgcagatgctgctgctgtcacaacatgaactgctgacacagtcctttaccttgctccacctctgcagtgatcataagtgctttgtgcccagaggccactgaagatggtaggcaggattctttccaagaacccaaactgcctttgcctcagctttatggttacctaaaattgccactttttttaggttaaaaaaaacttcagtatcctcattaacatttgaagttggtttcttatgaatatttcgtggctaaaatgattttatagggaatctatcttctaggatctaagccactaaataaaaggataaatgaatgatgataagtcagtcactcatgtttgactctgttcttagaatgaagagaaggtgcatatgcatgtctcaatttctacctttttctgtggtatcggctatactagggaaccattttgtagaagaaggaacgatgacaggtcgcatgaagatcagcctctagtactgatgatctttacttatgcatcttcctgagcaactttctaggctaggatttctaaattggtgaaaaaagcagcattagagtgccagaattagcactggggaaaactggccaggggaacacaaagcaggagacagcctgcgttaattttttttttttaataattttcaaaagcagtggtagaaaatttgataagaatgctttatgtttaggacaacaaaaataattttaaaaagttattttttaccctaatacttttctccactgaatattattatttttttcttagctttttctttctagatgtattccccaacatgctcacatacacagatctttccctttccttactagacctctctttagtttaagataagtttagacaggagaaagtgtatgtaaactacctgaaaggatgacaatcaatacaatgacaaatatgccagtttatttaatttgtttaaaaaaaaaaaggcagaaaacccaccatgggaaaataagcattttttaaaatctgaagttgctcttttcctgtgtggtctttgggaggagtctaatacaaaaactgaaaacctttggtcctgggaatttattttcatggctgttgtcatggctgagtagttttttgatgaattcaatcaatgcagagaacgcttttagataaatcagaactctccttaaaatgcatttcaatcagaagcaaagtacacccattatttatgcagacatgtaaaaaatctaaaaattcttgcaatgagtagtataagccacctatttttacttccttctctgaaatattccagttaactcagcttgggttctgtgctcctcctctcttcctatagaacactgtgcataccttgaataaagagcttattatacta

SEQ ID NO: 144306 - DNA, 526 bp, Homo sapiens
  Payload ID: 8512
  Gene Symbol: IFT57
  Gene Name: intraflagellar transport 57
  ENST ID: ENST00000492106
  CDS Start-End: 54-526
aggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccaggtgggtgccggcgtccccgagcgcccgggtgcctgctagcccccagggagatgccctccttggtcctgctgggaaccagtttcgtgagagcggacactattttgcactgcctaccaaccctggcgaacagttctacatgttttgtactcttgctgcttggttgattaataaagcgggacgtccctttgagcagcctcaagaatatgatgaccctaatgcaacaatatctaacatactatccgagcttcggtcatttgtaag

SEQ ID NO: 144307 - DNA, 931 bp, Homo sapiens
  Payload ID: 8512
  Gene Symbol: IFT57
  Gene Name: intraflagellar transport 57
  ENST ID: ENST00000478157
  CDS Start-End: 114-359
gtccggtggtcgcctggtaaccggtcgtggctgtactggcggcggcagggctggcggcttaggccgcagaggtctgtgggcctgagcccacgctggactctgtccgttctgcgatgactgctgctctggccgtcgtcacgacgtcgggtttggaagatggggtgcctaggtcccgtggcgaagggaccggggaagtggtcttggagcgggggcccggcgcggcctaccacatgttcgtggtgatggaggacttggtggagaagctgaagctgctccgctacgaggaggagttcctccggaagagcaacctgaaggccccgtccagggaagaactgcagattttcctccttcaaaattaaagtcaggttatggagaacatgtatgctatgttcttgattgcttcgctgaagaagcattgaaatatattggtttcacctggaaaaggccaatatacccagtagaagaattagaagaagaaagcgttgcagaagatgatgcagaattaacattaaataaagtggatgaagaatttgtggaagaagagacagataatgaagaaaactttattgatctcaacgttttaaaggcccagacatatcacttggatatgaacgagactgccaaacaagaagatattttggaatccacaacagatgctgcagaatggagcctagaagtggaacgtgtactaccgcaactgaaagtcacgattaggactgacaataaggattggagaatccatgttgaccaaatgcaccagcacagaagtggaattgaatctgctctaaaggagaccaagggatttttggacaaactccataatgaaattactaggactttggaaaagatcagcagccgagaaaagtacatcaacaatcagcttgagaatttggttcaagaatatcgtgcagctcaagcccagctgagtgag

SEQ ID NO: 144308 - DNA, 2160 bp, Homo sapiens
  Payload ID: 8513
  Gene Symbol: IFT74
  Gene Name: intraflagellar transport 74
  Uniprot ID: Q96LB3
  ENST ID: ENST00000380062
  CDS Start-End: 164-1966
atcccgcccccgttgccgggatacgccgcggcgcacggcagttagtgggtaggcctgagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaa

SEQ ID NO: 144309 - DNA, 2119 bp, Homo sapiens
  Payload ID: 8513
  Gene Symbol: IFT74
  Gene Name: intraflagellar transport 74
  Uniprot ID: Q96LB3
  ENST ID: ENST00000433700
  CDS Start-End: 128-1930
tcgtcatggccagtgtctgtctggcgcccggtgcccaggcactgtgcgagaccagtccgcaggggcgactcggagagcgccgggccgcggcgggagaagagcctgcagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatatt

SEQ ID NO: 144310 - DNA, 1462 bp, Homo sapiens
  Payload ID: 8513
  Gene Symbol: IFT74
  Gene Name: intraflagellar transport 74
  Uniprot ID: Q96LB3
  ENST ID: ENST00000429045
  CDS Start-End: 58-1176
gcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaagatcctaccaactatggatggaaaatacttgaaaaaaatacaggaagtttcaaaaagcaagtttgaacctgccatgtgctaagcactatgctgaatccatttgaactgaagaataccctgctatagcctcccattgtttcacagatcttcagtctctctctagcacccactgtttgagcagtgttcatctggcattttattcattggctacttgtgttcactctttgcttctgtgaaaaaaaaaagactcctaaaaatcaattatatggtgaaagaaatcccttacagactaagagagagcgtaaagtgctgtctctcaacaagaaaataaaattcttagatcttttgaaaa

SEQ ID NO: 144311 - DNA, 2163 bp, Homo sapiens
  Payload ID: 8513
  Gene Symbol: IFT74
  Gene Name: intraflagellar transport 74
  Uniprot ID: Q96LB3
  ENST ID: ENST00000443698
  CDS Start-End: 172-1974
gacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtgcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatatt

SEQ ID NO: 144312 - DNA, 652 bp, Homo sapiens
  Payload ID: 8513
  Gene Symbol: IFT74
  Gene Name: intraflagellar transport 74
  ENST ID: ENST00000519968
  CDS Start-End: 128-652
tcgtcatggccagtgtctgtctggcgcccggtgcccaggcactgtgcgagaccagtccgcaggggcgactcggagagcgccgggccgcggcgggagaagagcctgcagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatg

SEQ ID NO: 144313 - DNA, 563 bp, Homo sapiens
  Payload ID: 8513
  Gene Symbol: IFT74
  Gene Name: intraflagellar transport 74
  ENST ID: ENST00000517444
  CDS Start-End: 184-563
gtcccaaccgccgacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtgcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattc

SEQ ID NO: 144314 - DNA, 563 bp, Homo sapiens
  Payload ID: 8513
  Gene Symbol: IFT74
  Gene Name: intraflagellar transport 74
  ENST ID: ENST00000518614
  CDS Start-End: 125-563
agttagtgggtaggcctgagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagacggagttttgcttgtcacccaagctggagtgcaatgatgggatctcacgtcactgcaacttccaccgcctggattcaagtgattctcttgcctcagcctcgtgcctgtaatctaagtaaaataagtgaactta

SEQ ID NO: 144315 - DNA, 652 bp, Homo sapiens
  Payload ID: 8513
  Gene Symbol: IFT74
  Gene Name: intraflagellar transport 74
  ENST ID: ENST00000517866
  CDS Start-End: 211-652
gggtcatctacagaggactagagagccagtcttttcctaaataaggaaaggaatgtgagctggggctgtggcatgcctgggcatgtagtaaaatcagaaagaagaaaaaaggagaagaaaggcagggggtacctggaattagagaataagtagctgagcaggctatttgaagagaaaccttgccatatctcacatcttttatatcttctcatgcctatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaa

SEQ ID NO: 144316 - DNA, 4306 bp, Homo sapiens
  Payload ID: 8514
  Gene Symbol: IFT80
  Gene Name: intraflagellar transport 80
  Uniprot ID: Q9P2H3
  ENST ID: ENST00000326448
  CDS Start-End: 434-2767
gcgcatgcgcgaactcctggcgggacctacgcggtagaagtttctactaagtgaaaaggaagagcgagggattcttttctctgtggtctacagcagcagcactattattaaaaatatttggaaagacaacctggcaagttttgaaaaagatttttttaaaaacggtagggttccgctcacagtgggaggcggggctcagtggtccagaaacgcctcttcagaagagggcgggctcgccgagaggcggggtctcgggcccactcggatgacgtgccgcgtagaagtatcgcgggaagaggaagggagcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaacaa

SEQ ID NO: 144317 - DNA, 567 bp, Homo sapiens
  Payload ID: 8514
  Gene Symbol: IFT80
  Gene Name: intraflagellar transport 80
  ENST ID: ENST00000468218
  CDS Start-End: 442-567
aactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagctggtttccaaaaagtttgggtgtaaagaaacaaacccaggcagaaagctttgtcctcacaagttctgatggtgtggtatatttattggcacatcgtttctgaagcatagacatatacccagaccataggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgct

SEQ ID NO: 144318 - DNA, 554 bp, Homo sapiens
  Payload ID: 8514
  Gene Symbol: IFT80
  Gene Name: intraflagellar transport 80
  ENST ID: ENST00000483325
  CDS Start-End: 1-369
gttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaagccttctctgagagaagacttttggtaatttttttttaaaggacttcctttttggctaagaaagaggaaaacagaatggaataatatagtatccagatggcagacagaattaagataactataaattgtgaaaataatagtaatttggaagccagatttttgttttcaataaacttaagattgaaagtccctgtga

SEQ ID NO: 144319 - DNA, 539 bp, Homo sapiens
  Payload ID: 8514
  Gene Symbol: IFT80
  Gene Name: intraflagellar transport 80
  ENST ID: ENST00000486856
  CDS Start-End: 442-539
agaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatatccttttaatgcttataaatcttattggattttcttaattatagtattgttaaaagtttctctattttatatcctagttgaagaatagattttttttttcattcctttagtggctgtttacctaaattgttttaaagtatttaagatcatgtgttttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagct

SEQ ID NO: 144320 - DNA, 4044 bp, Homo sapiens
  Payload ID: 8514
  Gene Symbol: IFT80
  Gene Name: intraflagellar transport 80
  Uniprot ID: Q9P2H3
  ENST ID: ENST00000483465
  CDS Start-End: 589-2511
tgcaggtctgtgaaagaataggtaaataaattgaaagtaagggctgagaaatttttgtagcaatttgacattgttataatgtccaatttttctaatattttatttttattgtatcttacgaaatatccatatgcaatggattcgaaataaagaaaaatctggtccttcatcagaactaggaaagcactgatttaaacatttggtcagacattttaaattgaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttct

SEQ ID NO: 144321 - DNA, 610 bp, Homo sapiens
  Payload ID: 8514
  Gene Symbol: IFT80
  Gene Name: intraflagellar transport 80
  ENST ID: ENST00000489004
  CDS Start-End: 247-610
atcgcgggaagaggaagggagcgtaactcttagaagtcactatggtgacggggaggtaccaggtatttgagagcaatcgccaccgctttcctggaacttgaggctggagtgcagtggtgtgatctcggtttactgcaacctccacctcctgagttccagcgattctcctgcctcagcctcctgagtagctgggattacagtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattag

SEQ ID NO: 144322 - DNA, 574 bp, Homo sapiens
  Payload ID: 8514
  Gene Symbol: IFT80
  Gene Name: intraflagellar transport 80
  ENST ID: ENST00000482317
  CDS Start-End: 118-405
agaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatgatttttcaaatgtaatttctttcaggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagct

SEQ ID NO: 144323 - DNA, 860 bp, Homo sapiens
  Payload ID: 8514
  Gene Symbol: IFT80
  Gene Name: intraflagellar transport 80
  ENST ID: ENST00000465537
  CDS Start-End: 495-860
tatggtgacggggaggtaccaggtatttgagagcaatcgccaccgctttcctggaacttgagtaaatacaatcaagtggcatcttaaatttttgctggaagtggagtcatgagactaaagatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactggg

SEQ ID NO: 144324 - DNA, 529 bp, Homo sapiens
  Payload ID: 8514
  Gene Symbol: IFT80
  Gene Name: intraflagellar transport 80
  ENST ID: ENST00000475677
  CDS Start-End: 298-529
attgtcgctcctgcgcatgcgcgaactcctggcgggacctacgcggtagaagtttctactaagtgaaaaggaagagcgagggattcttttctctgtggtctacagcagcagcactattattaaaaatatttggaaagacaacctggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtat

SEQ ID NO: 144325 - DNA, 542 bp, Homo sapiens
  Payload ID: 8514
  Gene Symbol: IFT80
  Gene Name: intraflagellar transport 80
  ENST ID: ENST00000478536
  CDS Start-End: 350-542
attgtcgctcctgcgcatgcgcgaactcctggcgggacctacgcggtagaagtttctactaagtgaaaaggaagagcgagggattcttttctctgtggtctacagcagcagcactattattaaaaatatttggaaagacaacctgctcatcagccatcattaatgttagtgtattttatgtgtggcccaagacaattcttcctccaatgtggcctagggaagccgaaagattggacacccctgataaagtaaacggccatactgtttgctgtggctaagcctttgagtccgtgcctggaaatgtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggt

SEQ ID NO: 144326 - DNA, 719 bp, Homo sapiens
  Payload ID: 8514
  Gene Symbol: IFT80
  Gene Name: intraflagellar transport 80
  ENST ID: ENST00000498409
  CDS Start-End: 181-719
tgcgcatgcgcgaactcctggcgggacctacgcggtagaagtttctactaagtgaaaaggaagagcgagggattcttttctctgtggtctacagcagcagcactattattaaaaatatttggaaagacaacctgtaaatacaatcaagtggcatcttaaatttttgctggaagtggagtcatgagactaaagatatctcttttaaaagaaccaaagcatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaa

SEQ ID NO: 144327 - DNA, 382 bp, Homo sapiens
  Payload ID: 8514
  Gene Symbol: IFT80
  Gene Name: intraflagellar transport 80
  ENST ID: ENST00000484963
  CDS Start-End: 1-168
tatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactggg

SEQ ID NO: 144328 - DNA, 687 bp, Homo sapiens
  Payload ID: 8514
  Gene Symbol: IFT80
  Gene Name: intraflagellar transport 80
  ENST ID: ENST00000472555
  CDS Start-End: 1-209
gtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtttttattccatcagatgaaagactataaacaagcaaaagtaacatattttaaatggtaatgagtgctataaaaattaagctgggcgaaggagatggcattttttaaatgagatgatcaggaaatataaaaacaaatatagaaactaattgtacattactggatgtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaa

SEQ ID NO: 144329 - DNA, 3073 bp, Homo sapiens
  Payload ID: 8514
  Gene Symbol: IFT80
  Gene Name: intraflagellar transport 80
  Uniprot ID: Q9P2H3
  ENST ID: ENST00000496589
  CDS Start-End: 806-2728
actcggatgacgtgccgcgtagaagtatcgcgggaagaggaagggagcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatatccttttaatgcttataaatcttattggattttcttaattatagtattgttaaaagtttctctattttatatcctagttgaagaatagattttttttttcattcctttagtggctgtttacctaaattgttttaaagtatttaagatcatgtgttaaaaatctggtccttcatcagaactaggaaagcactgatttaaacatttggtcagacattttaaattgaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaa

SEQ ID NO: 144330 - DNA, 579 bp, Homo sapiens
  Payload ID: 8514
  Gene Symbol: IFT80
  Gene Name: intraflagellar transport 80
  ENST ID: ENST00000478370
  CDS Start-End: 482-579
aactcttagaagtcactatggtgacggggaggtaccaggtatttgagagcaatcgccaccgctttcctggaacttgaggctggagtgcagtggtgtgatctcggtttactgcaacctccacctcctgagttccagcgattctcctgcctcagcctcctgagtagctgggattacagtaaatacaatcaagtggcatcttaaatttttgctggaagtggagtcatgagactaaagatatctcttttaaaagaaccaaagctggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagct

SEQ ID NO: 144331 - DNA, 3108 bp, Homo sapiens
  Payload ID: 8515
  Gene Symbol: IFT81
  Gene Name: intraflagellar transport 81
  Uniprot ID: Q8WYA0
  ENST ID: ENST00000242591
  CDS Start-End: 507-2537
tgggagcggtctagagcccgggcgcctcctggggggtggggaaacggtttcgtgaggagaatttgaggtaacctcgccaactcgcggtcggaagctcctctgaaccccgaaataggagagagctcccgtcctctctcggtcctgatgcagcacctcgcaagtggaaggggtcgtcgcggttaagcccccggataggggaatcgggccccttctgggattcgagcggatccaggccgctccctggagggatgaactgtcgaggggcccagggcagcccccgctagaggcccggtcgggtgtggggtcccctgtcccctgtcccgagcccggggagggggacactatttctggtactcccaggaggctgcgggtcgatgctcgtgccagcctgggacccaggcagcacggtttctctcccaaattgtgccagagaacacgcacgtcctggttttcattgttccccgcctcctgcgactcgtttgtggttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtgaattcttgtgtcatcgtttggggttttacttgataccactagctataagcctaatctcataatgtatttcttttttgaaactgatttgtatagcattttgttttcagaagagccattctttattaagttttcatagaaaataatgttaaggtagatttagtttgaatgttttttcatatgaaaaagaggcttttattcttttccatagtttagacatcactggcgtcttctgagttttatgagacaggaaactaagtttactatctgtaaatgtaaacatatgtccattaagaaacatgtagtttttttttagaatgtaataacccagtggcttactgtttttcttaatctcttttaaaaaaactttagaagaatcttttaggaactaatatctcttgttctgaagaaacatttatctgacgttcagcagttcctacagttttacttcagtttatttttcttctgtaaaatgcaagaaaatttaatattttgactaacatgtcttttctgtttgtatcatttaaaggcaaataaacttggtacgtatttcatatctatttaaaaaatgtata

SEQ ID NO: 144332 - DNA, 3048 bp, Homo sapiens
  Payload ID: 8515
  Gene Symbol: IFT81
  Gene Name: intraflagellar transport 81
  Uniprot ID: Q8WYA0
  ENST ID: ENST00000361948
  CDS Start-End: 549-1844
gtaactctacggcctagcaaccgttgccaaggagctcgactctgggagcggtctagagcccgggcgcctcctggggggtggggaaacggtttcgtgaggagaatttgaggtaacctcgccaactcgcggtcggaagctcctctgaaccccgaaataggagagagctcccgtcctctctcggtcctgatgcagcacctcgcaagtggaaggggtcgtcgcggttaagcccccggataggggaatcgggccccttctgggattcgagcggatccaggccgctccctggagggatgaactgtcgaggggcccagggcagcccccgctagaggcccggtcgggtgtggggtcccctgtcccctgtcccgagcccggggagggggacactatttctggtactcccaggaggctgcgggtcgatgctcgtgccagcctgggacccaggcagcacggtttctctcccaaattgtgccagagaacacgcacgtcctggttttcattgttccccgcctcctgcgactcgtttgtggttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagagacaggatctcactctgtcacccaggctggagtgcggtggtgtgatcatggcttactgcagcctgaaactcctaggctcaagtgatcctcctacctcagcctcctgagaagctcggactacaggcacgagccaccatgcccagctaattttctttttttgttttgttttgtagagatgtggtctcactatgtttcccaggctggtcttaaactcccggcctcaagcagtcctcccacttcggcctcctgaagtgttaggattacaggcgtgagcctgcgcctggctgtaattactatacccagtttttacagataaaggatctgagacatgcagaggttttaagctgacttgcctgacaccccattgctagtaagtagtagaaccaggagttggatttagcagtctggctgtagagtcatcaatagtttgcacatgacagaaagctggaagaaatagtcaacctgaaacacatgatggaattataattcagaatcatcttggtagataggggcactgtgcttaaacaaaatgccattaatgggattataataaatataatgtggtagaattcaagttttgtttgccaattcaacacatcatctgttactaacgcagctttaaaaaatgcataaacgattatactacattaatttttttaaaaagtatcctgtttatggtctgattatgcctggagtattattttatatttttgacttcatgttttaagagacaatcatgccagagtcccacatgagggtgactaaaatggacaaaaagtctggaaactttcatatcaataattgattatgtattaactgaaacaaaagactagagaaagacacagtgggaattgattatgtattaactgaggaataaaagactgaagaaagacataataaatagttaaaggattatggaaaagatggtgttcagaaaaaaattaacatgcaggcctgagactgctatccctagaaaggtctgcttgcaaagttggcccttggctggcatctgggggaacttggttcttggatggattcctgccattcactgataagaatggctcaccttgcctaaagtatatgaagagtgtgctttatgtcgagctcctgcttgcttgcctctttctttgtctttctttcttttccttcctcccttccttccttccttccttccttccttccttccttccttccttccttccttccttcctctctctctctctttctttctttcttctttctggaattttggtacaggctaggcagaatgtgcctagatgatcagctcctagtaaaaaccttgagaactaa

SEQ ID NO: 144333 - DNA, 2694 bp, Homo sapiens
  Payload ID: 8515
  Gene Symbol: IFT81
  Gene Name: intraflagellar transport 81
  ENST ID: ENST00000550156
  CDS Start-End: 1-1873
aatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagagacggaatctcactctgttgcccaggctggagtgcagtggcacaatcttggctcactctgccttccagtacagatgggatttcaccatgttggccaggctggtctcgaactcctgacttcaggtgatctgcccacctatatagcatgagtcctgttttccacttgaaactccaagcatacctgacatataacagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtgaattcttgtgtcatcgtttggggttttacttgataccactagctataagcctaatctcataatgtatttcttttttgaaactgatttgtatagcattttgttttcagaagagccattctttattaagttttcatagaaaataatgttaaggtagatttagtttgaatgttttttcatatgaaaaagaggcttttattcttttccatagtttagacatcactggcgtcttctgagttttatgagacaggaaactaagtttactatctgtaaatgtaaacatatgtccattaagaaacatgtagtttttttttagaatgtaataacccagtggcttactgtttttcttaatctcttttaaaaaaactttagaagaatcttttaggaactaatatctcttgttctgaagaaacatttatctgacgttcagcagttcctacagttttacttcagtttatttttcttctgtaaaatgcaagaaaatttaatattttgactaacatgtcttttctgtttgtatcatttaaaggcaaataaacttggtacgtatttcatatctattta

SEQ ID NO: 144334 - DNA, 1171 bp, Homo sapiens
  Payload ID: 8515
  Gene Symbol: IFT81
  Gene Name: intraflagellar transport 81
  ENST ID: ENST00000546374
  CDS Start-End: 74-1171
gcccgggcgcctcctggggggtggggaaacggtttcgtgaggagaatttgagttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgag

SEQ ID NO: 144335 - DNA, 2710 bp, Homo sapiens
  Payload ID: 8515
  Gene Symbol: IFT81
  Gene Name: intraflagellar transport 81
  Uniprot ID: Q8WYA0
  ENST ID: ENST00000552912
  CDS Start-End: 131-2161
gtaactctacggcctagcaaccgttgccaaggagctcgactctgggagcggtctagagcccgggcgcctcctggggggtggggaaacggtttcgtgaggagaatttgagttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctccactggcttcttcagaggactaatgaactgaagaaaagagcatatttagctcgttttttaataaaacttgaggtaccaagtgagtttcttcaggatgaaactgtggctgacaccaataaacagtatgaagagttaatggaagcctttaaaactttgcataaagaatatgagcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaagtttaatgaagaggctagaggaggagataaaatttaatttatatatggtaactgaaaaatttcctaaagaattagaaaataagaaaaaggaattacattttttacaaaaagtagtttcagagccagctatgggccattctgatcttcttgaacttgaatctaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtgaattcttgtgtcatcgtttggggttttacttgataccactagctataagcctaatctcataatgtatttcttttttgaaactgatttgtatagcattttgttttcagaagagccattctttattaagttttcatagaaaataatgttaaggtagatttagtttgaatgttttttcatatgaaaaagaggcttttattcttttccatagtttagacatcactggcgtcttctgagttttatgagacaggaaactaagtttactatctgtaaatgtaaacatatgtccattaagaaacatgtagtttttttttagaatgtaataacccagtggcttactgtttttcttaatctcttttaaaaaaactttagaagaatcttttaggaactaatatctcttgttctgaagaaacatttatctgacgttcagcagttcctacagttttacttcagtttatttttcttctgtaaaatgcaagaaaatttaatattttgactaacatgtcttttctgtttgtatcatttaaaggcaaataaacttggtacgtatttc

SEQ ID NO: 144336 - DNA, 549 bp, Homo sapiens
  Payload ID: 8515
  Gene Symbol: IFT81
  Gene Name: intraflagellar transport 81
  ENST ID: ENST00000551273
  CDS Start-End: 1-314
agcagctcaagatatctggattttctacagcagaaataagaaaggatatcagtgcaatggaagaagaaaaggatcagctcattaagagagttgaacatttgaagaaaagggttgagacagctcagaatcatcaatggatgcttaaaatagcaaggcaacttcgagttgaaaaagagagagaagaatatcttgcacaacagaaacaggaacaaaagaatcagctatttcatgcagtgcaaagattgcaaagagtacaaaaccagctgaaaagcatgcgccaagctgcagcagatgcaaagcctgaaaataaatgaaataaacacagaaattaaccagttgattgaaaagaaaatgatgagaaatgagcccattgaaggcaaactctcactgtataggcaacaggcatctatcatttcccgtaaaaaagaagccaaagctgaggaacttcaggaggccaaggagaagttagccagcctagagagagaagcatcagtaaagagaaatcagacccgtgaatttgatggtactgaagttttaaagggagatgag

SEQ ID NO: 144337 - DNA, 2856 bp, Homo sapiens
  Payload ID: 8516
  Gene Symbol: IFT88
  Gene Name: intraflagellar transport 88
  Uniprot ID: Q13099
  ENST ID: ENST00000351808
  CDS Start-End: 195-2669
cgcaccacccccttcccgccgcgctctctcccgcccccgcgcttccggccccgcccgcccccgcgcggaggactgtgggagcggcttccttggattccgcgcttggcaacggctcggcgtcgcgctttggccaaccgctgcgtcgtccctgggcccgaataactgtcgcccgcttccctcagcgtgaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacagtagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaact

SEQ ID NO: 144338 - DNA, 3091 bp, Homo sapiens
  Payload ID: 8516
  Gene Symbol: IFT88
  Gene Name: intraflagellar transport 88
  Uniprot ID: Q13099
  ENST ID: ENST00000319980
  CDS Start-End: 328-2829
ggactgtgggagcggcttccttggattccgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaaaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacctccaataactgctaaaatatcaagcacggcagttactagacctatagctactggatatgggtccaagacatctctggcatcatcaataggaagaccaatgacaggggctattcaggatggagttactagacccatgacagcagtgagagcagctggttttaccaaagcagctttgagaggctctgcatttgacccccttagtcagtcaaggggccctgcttcccctttggaagccaagaaaaaagatagcccagaggaaaaaataaagcaattagagaaggaagtaaatgagttggtagaagaaagctgtattgccaatagttgtggagacttaaaattggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacagtagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgagtcatataggtattttccttgtaatattgaagtcattgagtggcttggagcctattacattgacacccaattttgggaaaaagctattcagtactttgaaagagcttctcttatacagcctacacaagtgaaatggcagctgatggtagctagttgtttcagaagaagtggtaactaccaaaaagcattagatacttacaaagatactcacagaaaatttccagaaaatgtcgaatgtctgcgtttcttagttcgtctctgcacagatcttggattaaaagatgctcaagaatatgccagaaaactgaagaggttggaaaaaatgaaagaaataagggaacagcgcataaagtcaggcagagatggcagtgggggctcccgtggcaaaagagaaggaagtgctagcggtgatagtggccagaactatagtgccagtagtaaaggtgaacgactaagtgccagactcagagctttacctgggacaaatgaaccttatgaaagtagcagtaacaaagaaatagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaa

SEQ ID NO: 144339 - DNA, 575 bp, Homo sapiens
  Payload ID: 8516
  Gene Symbol: IFT88
  Gene Name: intraflagellar transport 88
  ENST ID: ENST00000389373
  CDS Start-End: 426-575
cgcgcttggcaacggctcggcgtcgcgctttggccaaccgctgcgtcgtccctgggcccgaataactgtcgcccgcttccctcagcgtgaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtacaaatgatgcaaaatgtgcacctggctccagagacagatgaagatgatctttattccggctataatgactacaatccaatctatgatatcgaggaattggagaatgatgcagcttttcagcaagctgtgaggactagtcatggcagaagacct

SEQ ID NO: 144340 - DNA, 2590 bp, Homo sapiens
  Payload ID: 8516
  Gene Symbol: IFT88
  Gene Name: intraflagellar transport 88
  ENST ID: ENST00000537103
  CDS Start-End: 1-1105
ggccttagaaaaggcaaaagatgcaggaagaaaagagagagtcctggtgagacagcgagaacaagttacaactccagaaaatatcaatttggatttaacttactcagttcttttcaatttggccagtcagtattcagttaatgaaatgtatgccgaagcacttaacacttatcaagttatagtcaaaaataagatgtttagcaatgcaggaatattgaaaatgaatatgggaaatatctatttaaagcaaagaaattattccaaagccattaaattctaccgaatggcattagaccaagttccaagtgtcaataagcaaatgaggattaaaataatgcagaatattggagttacatttattcaggctgaccgagaaaaaatgaagaaggcattccaaaaattgattactgttccattagaaattgatgaagataaatatatttcaccaagtgatgatcctcatactaacttagtaactgaagctataaaaaatgatcacctcaggcaaatggaacgtgaaaggaaagccatggcagaaaaatatattatgacatctgcaaaactcattgctcctgtaattgaaacatcttttgctgcaggttatgattggtgcgtggaagtggtgaaagcttctcaatatgtagagctagccaatgatctggaaataaacaaagcagttacatacttgagacaaaaagactataaccaagctgtagagatcttaaaagtgttggaaaaaaaggacagtagagtgaaaagtgcagctgcaaccaatctctcagccctgtattatatgggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggccttacctatgagaaactaaatcggctagatgaggctttggactgtttcctgaaacttcacgcaatcctacgaaacagtgccgaagttctttaccagatagcaaatatgtatcttatttgaaaaccttagggacagttattaattctctcaattggtgattgaagatcaattattaaataagtttaactaatgaagtaattgatgaggataatatttgaagtaagtgatgaggataatctggcagattattgtgtgataaatatcatttgagtaatcctattttaagatgtagtttgcatcgaaagaggaattaatggttaaaactattatttattaaattttgaaaataactgaagtaattaggacattttcggtacatataagccattcattgaaagtcaatttggtgctttagaacgttgtattaattctgaagcttgtagggtatcattgaagcactaacttactaaataaaatactgtttattactgattactattgattgaatttggataatttttcttacttttttagctggcctgtagatataatgaggtctccaaagactgttaccctctaaaattatgtaattcttcatatgaactcattcattctgttcatttaatagtcatttattgaatgtatactatgtgtatcagtattatgtttcaaactcaggggaatgtagaactacaaaatgttgcgctaatatcagtttcttccacaacacttagctttcttaataagccctgctcttggttagaaaagcagaaatgtgttaatgtttttaatgcttttcatgctatttgaaaagcacttttaatttctctccttattttggtaagctttggccacaacattgggaagagttaaacatcttaggtagattttcaacttactgttatcttggtttaaattttatacaaatatgtttagaaaattttatatgttgtgaggtgtaccattaataattttaagtactatctgctgtacttttgataaagaattttattgaaaaattttagttttaggccaggcacagtagctcacacctgtaatcccagcactttgggaggccaaggcaggcggatcatttgaagtcaggagttcgagaccagcctggccatcatggtgaaaccccatctctactaaaaatacaaaaattagccgggtgttgtggcaggcacctgtaatcccagttactcccgaggctgaggcaggagaatcacttgaacctgggaggcagaggttgcagtgagccaagatagtgccactgtactccagcctaggtgcagagctagactatctcaaaaaaaaattagttttagagcagatagcatcatagttactcctgttagtctttttgttctgttttgttcatttaatttctctgaaactgccagtgtcattatcttttaccacccagttcatgatcagcttggatccagtcaagcaactgatgtatttgagactgtttgagtacattttcttttttttttttcttgtggtatcacacttgtcatcgttaaaaacagtagatcttctggtgtcactcttgtcaccattgaaaacaatgcttctttttcaataaactttgaattggaa

SEQ ID NO: 144341 - DNA, 713 bp, Homo sapiens
  Payload ID: 8517
  Gene Symbol: INIP
  Gene Name: INTS3 and NABP interacting protein
  ENST ID: ENST00000374234
  CDS Start-End: 187-354
agcgcagcgggggcgggaaggttgtagtgccgcgagttgagctcctcttgcctaagtggtcgcgccccctttaagagcagcgattgtaaggagaggcggtcccggtgtcctcgggtcccaggttttcaaaacaaaaatagagttgcaatcttggcagaactggacaaagagaaaagaaaactacttatgcagaaccagtcttcaacaaatcatcctggagctagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatg

SEQ ID NO: 144342 - DNA, 874 bp, Homo sapiens
  Payload ID: 8517
  Gene Symbol: INIP
  Gene Name: INTS3 and NABP interacting protein
  ENST ID: ENST00000374236
  CDS Start-End: 229-453
ggggtttccgctccctggggcgcacgtcagtcaggaggcggaagcgcagcgggggcgggaaggttgtagtgccgcgagttgagctcctcttgcctaagtggtcgcgccccctttaagagcagcgattgtaaggagaggcggtcccggtgtcctcgggtcccaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatcc

SEQ ID NO: 144343 - DNA, 4233 bp, Homo sapiens
  Payload ID: 8517
  Gene Symbol: INIP
  Gene Name: INTS3 and NABP interacting protein
  Uniprot ID: Q9NRY2
  ENST ID: ENST00000374242
  CDS Start-End: 307-621
tttggaaaaaaaagtgacgtctgcactgaggtggccgctaaagtgcgaatcacgacgggcggtggccgttgggtcccggcgggaggcggggtttccgctccctggggcgcacgtcagtcaggaggcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagtttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctaggcaacatagtgagacccctgtctctactaaaaaattaaaaaaaaaaaaaaaagattggctaggtgtgctggtgcatgcatagagtcccagccactcgggaggctgaggtgggaggattgcttgagcctgggaggttgaggctgcagtgggccatgattgcacaacttggcaacagagtgagaccctgtctctaaatcaatcaatcaagcgagccagaatgcagtagtggcctgagagaggcatcctggaacgcagtgcggtctggctaggcttagaagtattcatgtgatttttacctgacaagggaaggaagagctgctccacgtgcagagcaaggtttcagaatgagaggagaagagcaggcactgcagagggtgagggaaagggcagcagtggactgggaagccctcaggtggaggtcagcattgcttccctcagatcatgggtgaatttgaggaactcagttaatatctttgtatgttcctccctccataaggtgagaacaagcacatgctctgcccatgtcagaaattgtctagactagtgtttttcaaagtgcaaaagcctcaacccattactgagttgagaagccaacttaatggtttaacaggattgaccagcattttttccgaaaaaatcaaaaacatctgagtgtactgcatatagaaataggtggttttgcctcatgaatattctgtttctgtgtgttcctatattttactttgtattgtgttggttttttaagagacagtcctgctctgtcatccaggctggagtgcagtggtataatcatagctcactgcaagactccttgaatccctgggctcaagcaatcctcaacccttagcctcccaagtagctgagactacaggcacatgccaccatgcccagctaatttttttttttttttaatttttgtagagacagcatcttgctatgttgcccaggctggtcttgaactcttggcctcaagcagtcctctcgatcctcccaccttggcctcctaaagtgctgagattacaggtgtgagccactgcatctggcttacttattttgtctattgtctgttccactagtatgtaaagtcttagagagcaagaatttttgtttatttctttctcttcctcctttcctttcttcctcttttacttcgttcactactgtattccacataaaatatatttggcatatagtaggtgttcaatatgttgaaggaatgaaagaatttatagacttgagttgcaatataaaatgtatttttttttactgtgagttatggcaaaaaaagttttgaaagccgcttctaaataatgcagatgtcagtgctttgaccctggaataaaaactgaaatgacttagtgatttcaaaggca

SEQ ID NO: 144344 - DNA, 13233 bp, Homo sapiens
  Payload ID: 8518
  Gene Symbol: INTU
  Gene Name: inturned planar cell polarity protein
  Uniprot ID: Q9ULD6
  ENST ID: ENST00000335251
  CDS Start-End: 104-2932
acatggcctctgccccttcccaagcagaggcaacatggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcgatacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtgatgtccttgttgctgtgaatgatgtcgatgttactactgaaaacatcgagagagttctgtcttgcattcctggacctatgcaggtgaaactgacatttgaaaatgcatatgatgtgaaaagggagacgtcccatccaagacagaaaaagacacagtccaacacaagtgatttagtcaagcttctctggggagaagaggttgaaggtatccagcagagtggcctaaacactcctcatatcattatgtatctcacactacagctcgactcagaaacctcaaaggaagagcaggaaattctttatcattatccaatgtctgaagcatctcagaaacttaaaagtgtgagagggatttttctcacactctgtgacatgctggaaaacgtaactgggacacaagttactagttcatccctccttttaaatggaaaacaaattcatgtggcttattggaaagaatctgacaagttgttgctaattggcctgcctgctgaagaagttcctcttcctcgtctaaggaacatgatagaaaatgtcatccaaaccttaaaatttatgtatggttctttagatagtgccttttgccagattgagaatgttcctcgtttggatcatttttttaacttgttctttcaaagagcacttcagcctgcgaaactgcattccagcgccagtcccagtgctcagcagtacgatgcttccagtgcagtacttttagacaacctccctggagtccggtggctcacacttccactggaaatcaagatggaattagacatggcattaagtgacttggaggctgcagattttgcagaactgtccgaggattactatgacatgaggcggctgtatacaattttggggtcttctctattttacaagggttatttgatatgcagtcatttgcccaaggatgatcttattgatattgccgtatactgtcgccactattgcctgctgcctttagcagcaaaacaaagaattggtcagttgatcatatggagagaagtgtttcctcagcatcacctccgacctttggcagactcaagcactgaagtctttccggaacctgaaggaagatattttttgctagttgttggcttgaaacattatatgctatgtgtactattagaagctggaggttgcgcatccaaagctattgggagtcctggaccagactgtgtatatgtggatcaagtcaaaacaactcttcaccagctggatggagtagattctcgcatagatgaacggctagcatcttctccagtcccctgtttgtcttgtgctgactggttccttactggatcacgtgaaaaaacagatagcttgaccacttcgcctattctcagtaggctacaaggtacttccaaagtagcaacttctccaacatgcagaagaacgctttttggtgactattccttaaagacacgcaagcctagtccttcctgtagtagtggaggatctgacaatggttgtgaaggtggagaagatgatggctttagcccccatactacaccggatgcagtacggaagcaaagagaatctcagggctctgatggtttagaagaaagtgggaccttgcttaaggtcactaaaaagaagtctactcttccaaatccatttcatttgggaaacttgaaaaaggaccttccagaaaaagaattagaaatatataacacagtgaaactgacatctggtcctgagaacacacttttccactacgttgccttagaaacagtgcaaggaatctttattactcctacccttgaagaggtggcacagctaagtggctctatccaccctcagctaataaagaatttccatcagtgttgtctttccattcgtgcagttttccaacagacattggtggaagagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacactgtcagaattgctgaaatcaatacacaaagagataaagtttagcttctttttactattcaatattgaacataatattgttaaatattgagatgaaatgctgttggatttgatacattaaatcttaatgtaatattgtaagacttttgagaatatacttgattaaaatgtgaaagaagggattgttaacttattgctattttggtatataatgttaatttattgactagtttgaaataatgtgaagtgttttttatatcagattaatataggaaatgtttattcttgaaaaatactcaatttgttgttgtttatttttctcaaaattcatactgatatctgatgaaatgattatgaaattgggagcaggtgaccaggtgctgtaactaagtagtgctatgaccatgagcaagtttttgtacctctctaagctcagagttttcatgtaaaatgagatgattgcattgaggtttcaaaaatacctcttaagtaaaatgtgcttttattttattttagttttagttttagttctggggtacatgtgcaggatgtgcaggttcgttacataggtaaacatgtgccatggcggtttgctccacctatcaacccatcacctaggtattaagcctagcatgcattagctatttttcctaatactctccctacccccacaacaggccctggtgtgcattgttcccctccctttgtccatgtgttctcatggtcagctcccacttataagtgagaacctacagtgtttggttttctgttcctgcattagtttgctgaggataatggcttccagcttcatccatgtccctgcagaggacatgatctcatacctttttgtggctgcatagtattccatggtgtatgtgtaccacattttctttatccagtctattgctgatgggcatttgggttgattccatgtctttgctattgtaaatagtgcttcaatgaacatatgtgtgcatatatatttgtaattgaatgatttatattactttgagtataaacccagtaatgggattgctgggtcaaatggcatttctggttctagatctttgaagaatcaccacactgtcttccacaatggttgaactaattcacattcccaccaacagtgtaaaagcgttcctatttcctcacagcctcgccagcatctgttatttcttgactttttaataatagccactctgactggtgtgagatgatatctcattgtggttttgatttgcatttctctaacaatcagtgatattgagcttttttttcatatgtttgttggctgcatgaatgtcttcttttgagaagtgtctgttcatgtcctttgcccagtttttaatgcggttctattttttcttgtaacttggtttgagttccttgtagatcctggatatcagatcattgttggatgaatagattgccaaaattttctcccactctgtaggttgcctgttcactctgatgatagtttcttttgctgtgcagaaggtctttaatttaactagatcccatttgtcaagttttgcttttgttgcagttgcttttgtgatttcatcatgaaatctttgcccatgctcatgtcttaaatggtattgcctagattttcttctagggattttatagttttgggctttacatttaagcctttattctatcttaattttttgtataaggtatgaggaatgggtccagtttctattttctgcatatggatagctagttctcccagcaccatttattaaataaggaatcctttccccattgcttgtttttctcaggtttgttgaagatcagatggttgtagatgtgcaatcttatttctgagttctctattctattccattggtctatgtgtcagtttttgtaccagtaccatgatgttttggttattgtacccttacagtacagtttgaagtttggtagtgtgatgcctccagctttgatcttttggcttaggattgccttggctatacaggctctttttttggttccatataaattttaaaatagttttttctaattctatgaagaatatcaatggtagtttaatgggaataacattgactctataaattactttgggcagtatggctattttcatgatattgattcttactgtctgtgagcatggaatatttttccatttgtttgtgtcctctctggtttccttgagccgtggtttgtagttctccttgaagaggtccttcacttcccttgttagctgtattcctaggtattttattctctttgaagcaattgtgagtaggagttcattcatgatttggatctctgcttgcctgttgttggtgtataggaatgctggtgacttctgcacaatgattttgtatcttgagactttgctgaagttgcttatcagcttaagaagcttttgggctgagacaatggggttttctagatataggataatgtcctctgcaaacaaagacattttgacttcctctcttcttctttgaataccctttatttctttctcttgcctgattgccctggccaggacttccaatactatgttgaatagtggtgagagaggtcatccttgtcttgtgctggttttcaaggggagtgcttccagcttttgcccattcggtatgatattggctgtgagtctgtcataaatggctcttattattttgaagtatgttccttcaatacctagtttattgagagtttttaacatgaaaggatgttgaattttattgaaggtgttttctgcatctattgagttaatcatgtggtctttgtctttagttctgtttgtgtgatgaattaagtttattgatttgcatatgttgaaccagcctcacatcccgggaatgaagccaacttgatcgtggtggataagctttttgatgtgctgctggattcagtttgccagtgttttattgagaatttttacattgatgttcatcagggatattggtctgaagttttctttttttgttgtatctctgccaggttttgatatcaggatgatgctggccttatagaatgagttagggaggagtctctccttttcatttgtttggaatagtttcagaagaagtggtatcagcttctttttgtatttctggcagaattcagctgtagatccatctggtcctgggctttttttggttggtagcctattaattactgcctcaatttcagaacttgttattggtctattcagtgattcaacttcttcctggttcagtcttgggagggtgtatgtgtccaggaatttatccatttcttctagattttcgagtttatttgcaccgagctgttatagtattgtctgatggttgtttatatttccatgggatcagtggtaatatcccctttatcattttttattgtgtctatttggttcttctctcttttcttctttattagtctagctaatagtctattttgttaatattttcaaaaaaaagcagcccctggattcatttattttttgaagggtttttcatgtctctagctccttcatttccactctgattttggttactttttgtcttctgctggcttttgggtttgtttgctcttggttcactagttcttttagttgtgatactagggtgtcgatttgagatctttctagctttttgatgtgggcatttagtgctataaatttccctcttaacactgctttagctatgccccagagattctggtacattgtctctttgttttcattggtttcaaagaacttcttgatttctctcttaatttcattatttacccaggagtcattcaggagcaggttgttcaatttccacgtagttttgtggttttgagtgactttcttactcttgagttccaatttgattgcgctgtgatctgagagactgtttgttattacttcagttctttagcatttgctgaggagtgctttacttctaattgtgtgatcaattttagagtaagtaccatgtggcactgagaagaatatatattctgttgtttgggggtggaaagatgtctagatatttatcaggtcccacttgatccagagctgaggtcaagtcctgaataactttgttaattttctgtctcgatgatctaatattgacagtggggtgttaaagtctcccactattattgtgtggaaatctaagtctctttttgggtctctaagaacttgttttatgaatctgagtgctcctatattaggtgcatatatatttaggatagttagctcttcttgttgaattgacccctttaccagtatgtaatgcctttgtcttttttttaatctttattcgtttaaagtctttgtcagaaactaggattgcagcctctcctttttctgttttccttttgcttggtagattttccttcatccttttattttgagtctatgtgtgtccttgcatgtgagatgggtctcttgaatacagcacactgatagagtttgactctatccagcttgccactctgcgtcttttatttggggcatttagtgcatttacatttaaggttaatattgttatgtgtgaattttatcctgacatcatgatgctagttgattattttgcagacttgtttatgtttttgcttcatagtgttactgatctgtgtatttcaatgtgttttttgtagcggctggtaacagtttttcctttccatattgagtgcttccttcaggagcacttgcaaggcaggcctggtggtgacgaattccctcagcatttgcttgtctgaaaaagattttatttctccttcacttatgaagcttagttcagccagatatgaaattctaggttggaaattctttcctttaagaatgttgaaaattggcccccaacctcttccagcttataaggtttctgctgagaggtctgctgttagtctgatgggcttccctttataagtgacctggcctatctctctgactgcccttaacattttttccttcatttcagtcttggagaatctgatgattatgtgtcttggggttgatctcatggagtattgtattggggttctctggatttcctgaatttgaatgttggcctgtcttgctaggttggggaagttttcctggatgatatccagaagtgtgttttccaacttggttccattcttctgtctctttcaggtatatctaccagtcgtaggttcagtcttttaacataatcccatagttctcagaggtttcattcattccttttcattcttttttctctaatcttgtctgcctgccttatttcagcaagatagtcttcaaactctgatatcctttcttccacttagtctatttggctatggatacttgtgtttccattataaagttctcatgtttttcagctccatcagatcatttacgttcctctccaaactggttattctgtttaacagctcctataatgttttattatggttcttagcttctttgcagtgagttagaacatattcccttagcttggtgaagttcgttatttcccatcttggatggatgattgacattcatccatctcagcctcagcccagttctgtgcccttgctagagacatgttgcaatcttttggaggagaagaggcactctggctttctgagttttccgtatccttgcattctttctcatcttcatgggtttatctacctttgatctttgagtctgctgacttttggatgaggtttttgtggtgtcttttttgttgatgttgttgcattctgtttttctttagtagtcaggcccctcttctgcagagctgctgcagtttgcctggggtccactctagaccctattcgcctgggtctctcgtcttccaggagatatcaccagtggaggctgcagaccagcaaagatggcagcctgctccttcctctgggagctctgtcccagaggggcactggcctgatgctagccggaatgctcctgtatgaagtgtctggagactcctgttgggaggtctcagtcagaaggagcggggtcagagaaccacttaaataagcagtctgtctgccccttgacagggtgggtgtgctacactggggggaatccccctcatctggactgccttgactctccagagccagcaggcagagaagactaagatcactgatccatgatacttcagccatccttcctcctaggggctcctcttggggttatcagcgttttgtccataaacccctggctggggatgctgagattcccacagggaggccctgtccagtgaagaggagtgaatctgggttccaccccatctcgccggcgctagcagcaagggaaagtggccaattgaagccgcagtgatggcggcctcccctcccttctcccccctctccttccccacttccagaactcagtcgtcttaggcagtttctagctggtgggggaggattccaagccagtgggttttagcttatagagttctgtgagagcaaggctgcttggctccctggcttcagccccctccccatgagagtggacagatctcctgcctcacgggagttcccagagccggagtatgcaaatactccagtgtctcagtgcctgctcaaagcggctgcccacccaagcagagatttgtgcttgggacccaaagctctggtagcattggctcaggagggaacctcctgatctacaagttgcaaggatctgtgggaaaagcctggttttcagggaggggaagcaaaatccttcaccatctcccttggctggacgagggagttcactttgctgcgtgcagttcctggatgggatcttgctccaccctgtttgcttgctctccgtgggtcatgccagccacctagcagtcccaataagagaacttcagtatctcaactgaagatgcagagttgactcacagttttcttccttcttggtgggagctgcagagcagagctgcctctctttgaccatctgggctctctgttctactttttttttttttttttttgcctcttgcatgttggtcacctcctaaattagtaatgtccaagtacttattccttatcagatacttttcgttaatttaactatcctagtacatacctcactgtggggaaagggggaaagatgaaaattaaacttactttttatttatttgattctctttaagtttcaggtaagctcaattttgactaggatatatatatgtgtgtgtgtgtatatatatgtattttttaaactatttgtcaactttatttttttttgtttgtttttgttaaaatacattcagcggctgggcttagtggctcacgcctgtaatctcaacactttgggaggctgaggcaggtggatcacttgagtccaggagttcaagaccagcctgagcaacatagcaaaaactccatctctacaaaaacaccaaaattagccgggtgtggtagcactctcttttaacagtcccagatacctgggaggctgaggtgggaagatcacctgagctcagtcggttgaggctgcagtgagctatgatcatgccactgcactctagcctgggcaacacagtgagaccctgtctcaaaaaaaaaaatcacattcaagtatatttcacatgcattttatataattcatgaatttcaggaaagctgcatgtaaatctttttttaaagctaaatcatgttaaagacactgaaaaagttaactaaaattctatggtgacttcttttataaaatactaatttttggccgggcacggtggtggctcacgcctgtaatcccagcactttgggaggccgaggcaggtggatcatgaggtcaggaattcgagaccagcctgaccaacatggtgaaaccccatctctactaaaaatacaaaaattagctgggcgtggtggtgtgcacctgtaatcctagctacctaggaggctgaggcaggagaatcgcttgaacccaggaagcagaggttgcagtgagccaagatcacaccaccgcacttctgcctgtggaacagaatgagactccgtctcaaaaaaaaaaaaaaaaatactaacttttatcttagaaatatagatcattatgcattgggttttttcaaagggggaacactttagtgaacaatagtttacttgacctttagttggaaaagaaaactaatggtggagaattttctttggctgggagaatttggtagattgagagaaaggaagaacatcaatactgcatttttacttgacatttaccctgtagatcctcctagaggttcgatgcccccaagacattccaacactgagctgtttcttctccaggtcttaagctttgaatacaagctataccagcacatctaaaatcggtctctacatttttccatcttaaatatgagctgtccagcttagtcaaaactaactgcaaaacactgggtgtaccatttgagtcatttggtcttaaaagaaacactattatcactgtgtcacagtttgagagattttcacttaagcatttaagttgcaaaccactacatatttgtcccattagtgactagtgggccttaattttggcattcaaattagggtaaaaaaccttggttcttgaaatgctacagaaaatagcttgaggccaggcacagttgctcacacctgtaactccagcactttggaaggctgaggcaggcagatcacttgaggtcaggcgtttgagaccaggctggtcaacatggtgaaaccctgtctctactaaaaatactaaaaaaaaaaaaaaaaaaaaaaaaattagccgggcatggtggcaggtgcctgaagtcccagctacttgggaggctgaggcaggagaatcacttgaacccaggaagcagaggctgcagtgagcctagctcgtgccactgccactccagcctgggcaacagaacgaggctctgtttaaaaaacaaaaaagcttgaaataccttccccttaagatcacaatattgtcatatgctaccatttgactcacaactgctgtcttaggactgcttatttacatatatatgtattaagacactttggttaaaacaatttattaaatgtcttaaatttctggatatgtccctgaaaataccatgaactacttctaatactgataattatgaataaacgtagctgttgatcacctcaggttttcatacaaactgaactaaggtagggttttatcataggggactttttgtttcatttaatgaaattttgatgtgttgaactgctttcctggtgtcagagaaacatgagaccatcgctcaataatggaaataaaaaggcagagcagactactgatcttaataaaaggaaaattatttgctgtatcgtagatgtgcactgtaatttccatgttaaagaggcactgcatttttaagaaataaaatcacacatcttattttttcatttctaaatggatattgaactaagctctgaaggcaaacttagctgcctatttttccaaatatgttcagaatcacatctgaaacatcaaactgattatcagacaataaagtgcctgttactttattaaataaagggggacaggatgacagtgcagatatcctagaaatatgctttagaagacatagaaacgttgttaaattggattttattagtatgcaaatgttcccttccaccaacaactattaatgtgaaaaactatatatagctagcattttttaaaatatcaaatactgtctcattatcatatgtttagcccccccaaaattacattttagactcttactttctctccctctcccctttctttagctcttgtttgtgtcttgccaaagaagtgtacctagtaagggaatgtttcttatttgtgccaagggactattgatgatgctgtataatggcaagatagcattttgtaatacctgcttttttatatttctaatacaaatgggcaaagctgtgaaaccaatttactaggtttttctgctttggacataattgtatgtgttaattctctctaaacagtgcctggcacatattacatgctataaaagtgttagctactactgctaccatttattattatcattattaaatatccattggttgaaaaaccaagtagtcagctaaatcatacctgctactgtacaaaatgtaggggaaaagctgagaaaaatcatttatcaataaacagttttcagaacaagaatttatactttggatatttttaaattgttaaatgttattgaaactttatgcaccaaaactgtatgaaataatttaattttgcagttgtgtttctatattctatgtaattaaagctacttttatactatattgatagttttaaataaaactggtttggaggtttgtttgca

SEQ ID NO: 144345 - DNA, 3006 bp, Homo sapiens
  Payload ID: 8518
  Gene Symbol: INTU
  Gene Name: inturned planar cell polarity protein
  Uniprot ID: Q9ULD6
  ENST ID: ENST00000503952
  CDS Start-End: 70-1377
atggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcgatacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtgatgtccttgttgctgtgaatgatgtcgatgttactactgaaaacatcgagagagttctgtcttgcattcctggacctatgcaggtgaaactgacatttgaaaatgcatatgatgtgaaaagggagacgtcccatccaagacagaaaaagacacagtccaacacaagtgatttagtcaagcttctctggggagaagaggttgaaggtatccagcagagtggcctaaacactcctcatatcattatgtatctcacactacagctcgactcagaaacctcaaaggaagagcaggaaattctttatcattatccaatgtctgaagcatctcagaaacttaaaagtgtgagagggatttttctcacactctgtgacatgctggaaaacgtaactgggacacaagttactagttcatccctccttttaaatggaaaacaaattcatgtggcttattggaaagaatctgacaagttgttgctaattggcctgcctgctgaagaagttcctcttcctcgtctaaggaacatgatagaaaatgtcatccaaaccttaaaatttatgtatggttctttagatagtatcatgaaggaattttctgtgattgtgtcatctgggaaaattatctagtttgcagtgttctctagaggaactgctgaggaggcacatccctgtcaaacctgattgcttaccaacattttccagataaagcacttcagcctgcgaaactgcattccagcgccagtcccagtgctcagcagtacgatgcttccagtgcagtacttttagacaacctccctggagtccggtggctcacacttccactggaaatcaagatggaattagacatggcattaagtgacttggaggctgcagattttgcagaactgtccgaggattactatgacatgaggcggctgtatacaattttggggtcttctctattttacaagggttatttgatatgcagtcatttgcccaaggatgatcttattgatattgccgtatactgtcgccactattgcctgctgcctttagcagcaaaacaaagaattggtcagttgatcatatggagagaagtgtttcctcagcatcacctccgacctttggcagactcaagcactgaagtctttccggaacctgaaggaagatattttttgctagttgttggcttgaaacattatatgctatgtgtactattagaagctggaggttgcgcatccaaagctattgggagtcctggaccagactgtgtatatgtggatcaagtcaaaacaactcttcaccagctggatggagtagattctcgcatagatgaacggctagcatcttctccagtcccctgtttgtcttgtgctgactggttccttactggatcacgtgaaaaaacagatagcttgaccacttcgcctattctcagtaggctacaaggtacttccaaagtagcaacttctccaacatgcagaagaacgctttttggtgactattccttaaagacacgcaagcctagtccttcctgtagtagtggaggatctgacaatggttgtgaaggtggagaagatgatggctttagcccccatactacaccggatgcagtacggaagcaaagagaatctcagggctctgatggtttagaagaaagtgggaccttgcttaaggtcactaaaaagaagtctactcttccaaatccatttcatttgggaaacttgaaaaaggaccttccagaaaaagaattagaaatatataacacagtgaaactgacatctggtcctgagaacacacttttccactacgttgccttagaaacagtgcaaggaatctttattactcctacccttgaagaggtggcacagctaagtggctctatccaccctcagctaataaagaatttccatcagtgttgtctttccattcgtgcagttttccaacagacattggtggaagagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaa

SEQ ID NO: 144346 - DNA, 737 bp, Homo sapiens
  Payload ID: 8518
  Gene Symbol: INTU
  Gene Name: inturned planar cell polarity protein
  ENST ID: ENST00000504491
  CDS Start-End: 133-737
gcgcgtcggaggctggcacctccaggttcaccgcggcggccggagctgtgcgggggccagacggttcggcgggagccggggctgggacctgggtgacctgtcgtccgcccctgtagcgagtctccagtgggcatgtttcaggtgggcaggtccagcatccccaaacctgccccccgcagcctggaggacctggactcagtgcagcgtgtcctgttacacagtgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcgatacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaa

SEQ ID NO: 144347 - DNA, 290 bp, Homo sapiens
  Payload ID: 8518
  Gene Symbol: INTU
  Gene Name: inturned planar cell polarity protein
  ENST ID: ENST00000506283
  CDS Start-End: 1-290
cttttagacaacctccctggagtccggtggctcacacttccactggaaatcaagatggaattagacatggcattaagtgacttggaggctgcagattttgcagaactgggttatttgatatgcagtcatttgcccaaggatgatcttattgatattgccgtatactgtcgccactattgcctgctgcctttagcagcaaaacaaagaattggtcagttgatcatatggagagaagtgtttcctcagcatcacctccgacctttggcagactcaagcactgaagtctttcc

SEQ ID NO: 144348 - DNA, 5740 bp, Homo sapiens
  Payload ID: 8518
  Gene Symbol: INTU
  Gene Name: inturned planar cell polarity protein
  Uniprot ID: Q9ULD6
  ENST ID: ENST00000503626
  CDS Start-End: 79-1305
agaggcaacatggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcgatacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtgatgtccttgttgctgtgaatgatgtcgatgttactactgaaaacatcgagagagttctgtcttgcattcctggacctatgcaggtgaaactgacatttgaaaatgcatatgatgtgaaaagggagacgtcccatccaagacagaaaaagacacagtccaacacaagtgatttagtcaagcttctctggggagaagaggttgaaggtatccagcagagtggcctaaacactcctcatatcattatgtatctcacactacagctcgactcagaaacctcaaaggaagagcaggaaattctttatcattatccaatgtctgaagcatctcagaaacttaaaagtgtgagagggatttttctcacactctgtgacatgctggaaaacgtaactgggacacaagttactagttcatccctccttttaaatggaaaacaaattcatgtggcttattggaaagaatctgacaagttgttgctaattggcctgcctgctgaagaaattgagttaccaagctcagcccacactcatggggagaggaattaagcctcacttcttgaggggaagagtatcaaagaatttgtggacctattttaccatcacaaacaggaattccaaagatggctacagtgaaaaatatcaaaatgattatgttttgaagaaattacgtaatttcttggacttctgtttacttatttgtataatgggaataataagagctaccttataaaattcttaaaaggcttcaatgagaaaatagttcctcttcctcgtctaaggaacatgatagaaaatgtcatccaaaccttaaaatttatgtatggttctttagatagtatcatgaaggaattttctgtgattgtgtcatctgggaaaattatctagtttgcagtgttctctagaggaactgctgaggaggcacatccctgtcaaacctgattgcttaccaacattttccagataagtgagctacaaagagctgggcatccataaatagtgcttttaccttttactagtaaggaaagttttaaccaatgaagagtaagaatgtggttatgaactgcctctttaagtttactcaacagaagaaaactttgccatattttgccctaattgaagctttctgttttcataaaaccagagattatcaaagattaaatttttgcaatgattttcatacatataaatagtccattggagttgtcctacaaattccattagagtagactggggacagagggacttaatttctctttcatcttgaaatttatcttccattgatagtggaagtatctttttgatggcagcaaatttaactcttttctacttcaagtgagaatttaaagagcaaactacgataataaatgtgaagatccattgagttcttaaaaccaagaagcacagtgaatccaggatgttattaatagacattttgtaataaatttttataacaactttttttctgattatgaaagatattaagggccaattgtgaaaaattacaagaagaccaaaaagtgtagagacttgattatctttttaaagttgtgagctggttaattctctatgagccacagaaaactgactatatactaacagtttaacgttgtgaccaaattaaagctataacaatttccttcaccattccccactaattcatcagcaagtcctgatcagtctgtcttcaaaatctccaatctgtccatttctctttatctttattattgccctgtccagccactgctatctctcacacactacagtagcctcctaactggtctccttcccttcattcttgccacttgaactaattttcatatagcagcgtgatctttctacattattatctggttcctacctacccctctgacttcagatatcaaaccacacgtgcctcctttgcactgtattgcaaacaccctggcaaagcttttccccagcccagggcttttgtactttttcttcttgctggatctttctgacattggaatatcagctcaaatgccctttctcagagattcttctccaaccattcaacctaaaatagccaatctgtcacaccacccattcatattgtgctattttctgcatagtcctttatatgaatttgtgttttttactttttgttcatttgctgtctttctccattagaacataagcttcatgggagctcattgtcttttgtcttgatatttttactgccatacctccagcaatgagaatagtgcctggaatgtagtagtcactcaaatatttgttagatgaatcagcaaataattattttgatatgccgatagcatatgtacctgctattttgtcattcagtgagctgttccaataaatgcttgcagtcaatgctgtgttacttttatatggctaaaaccaagtatttcggttttttctgtcattttgttttttgagttctttaatgttataccttcagtagtaaagaggggaggaaataacttatgcttattatgtacttactgtttaccagtaaataataagcataataagaacttatgcttgttatgttctaggcattctgcatgtgagctagattgtattaaccctgtttttacagagttggaaaccaaagttagagaaaggttaggtgatttgcctgtgatagctacctagaaagagctgtgataagccagatctgttctattacaaagttcaaaatctctttatcattccacgttgcctgaaagatttcaggagttgtaaatggttaaaagacagtcagaggtaaaaacaacctacattttttacaaaaagggtacttcagccctttcttttataaatatgtcacttgtgttagccctgtggttcttccatagagccatctacttgatacacttgagagtaggttttagggtaaaaagtttggacagggtaaatttctttacacaatccgtcagtaacattctagcagcaattctattgaaggaagagaggagtgaggaagatagcctatgtagttgggaaagatccagttcccttaggagcacacaaaaaatgaccaccatttccatatgtcgttctaacttacagctcttatttctccagtgccttttgccagattgagaatgttcctcgtttggatcatttttttaacttgttctttcaaagagcacttcagcctgcgaaactgcattccagcgccagtcccagtgctcagcagtacgatgcttccagtgcagtacttttagacaacctccctggagtccggtggctcacacttccactggaaatcaagatggaattagacatggcattaagtgacttggaggctgcagattttgcagaactgtccgaggattactatgacatgaggcggctgtatacaattttggggtcttctctattttacaagggttatttgatatgcagtcatttgcccaaggatgatcttattgatattgccgtatactgtcgccactattgcctgctgcctttagcagcaaaacaaagaattggtcagttgatcatatggagagaagtgtttcctcagcatcacctccgacctttggcagactcaagcactgaagtctttccggaacctgaaggaagatattttttgctagttgttggcttgaaacattatatgctatgtgtactattagaagctggaggttgcgcatccaaagctattgggagtcctggaccagactgtgtatatgtggatcaagtcaaaacaactcttcaccagctggatggagtagattctcgcatagatgaacggctagcatcttctccagtcccctgtttgtcttgtgctgactggttccttactggatcacgtgaaaaaacagatagcttgaccacttcgcctattctcagtaggctacaaggtacttccaaagtagcaacttctccaacatgcagaagaacgctttttggtgactattccttaaagacacgcaagcctagtccttcctgtagtagtggaggatctgacaatggttgtgaaggtggagaagatgatggctttagcccccatactacaccggatgcagtacggaagcaaagagaatctcagggctctgatggtttagaagaaagtgggaccttgcttaaggtcactaaaaagaagtctactcttccaaatccatttcatttgggaaacttgaaaaaggaccttccagaaaaagaattagaaatatataacacagtgaaactgacatctggtcctgagaacacacttttccactacgttgccttagaaacagtgcaaggaatctttattactcctacccttgaagaggtggcacagctaagtggctctatccaccctcagctaataaagaatttccatcagtgttgtctttccattcgtgcagttttccaacagacattggtggaagagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacactgtcagaattgctgaaatcaatacacaaagagataaagtttagcttctttttactattcaatattgaacataatattgttaaatattgagatgaaatgctgttggatttgatacattaaatcttaatgtaatattgtaagacttttgagaatatacttgattaaaatgtgaaagaagggattgttaacttattgctattttggtatataatgttaatttattgactagtttgaaataatgtgaagtgttttttatatcagattaatataggaaatgtttattcttgaaaaat

SEQ ID NO: 144349 - DNA, 483 bp, Homo sapiens
  Payload ID: 8518
  Gene Symbol: INTU
  Gene Name: inturned planar cell polarity protein
  ENST ID: ENST00000510766
  CDS Start-End: 1-280
aaagacacgcaagcctagtccttcctgtagtagtggaggatctgacaatggttgtgaaggtggagaagatgatggctttagcccccatactacaccggatgcagtacggaagcaaagagaatctcagggctctgatggtttagaagaaagtgggaccttgcttaaggtcactaaaaagaagtctactcttccaaatccatttcatttgggaaacttgaaaaaggaccttccagaaaaagaattagaaatatataacacagtgaaaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggagactttttcttcatccaaaacctcaagaactttatgtctgttttcatgactcagtcaca

SEQ ID NO: 144350 - DNA, 2968 bp, Homo sapiens
  Payload ID: 8519
  Gene Symbol: INVS
  Gene Name: inversin
  Uniprot ID: Q9Y283
  ENST ID: ENST00000262456
  CDS Start-End: 167-2854
cttttgaggggctcggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggccatgcacagattgtccatctccttttagaaagaaataagtctggaactatcccatctgacagccaaggagccacacctttgcactatgctgctcagagtaactttgctgaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagagggaagaacagctttgcattggtcctgcaacaatggataccttgatgccattaaattactgctagactttgctgctttccctaatcagatggaaaacaatgaagagagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaaaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatgaaacagccagagaacattctaaaggccaatctgcttgtgtccacttcagacccaatgaaggcagtgatggaagcaggcatccaggagttccctctgttgagaagtccagagagctccgactgcagataattcagagagaacgaaggaggaaggagctgtttcgcaaaaagaacaaggcagcagcagtcatccagcgcgcctggcgaagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggcccccaagagtccatccaagggcacctcaggcacaaagtccaccaagcactcagtgcttaagcaaatctatggttgttctcacgaagggaaaatacatcatcctacaagatctgtaaaagcctcttctgtgctgcgtctcaactcagtgagcaacctacagtgtatacatctccttgagaacagtggaagatcaaagaacttttcttataacctgcaatcagctactcagccaaaaaacaaaacaaaaccttgactgcctatggaggaagactgtgttcgggggagctggcatagctagtgcagagttcagattttctgctgataatcttttacaccttgggaaaactttaatatccgtacctgaagg

SEQ ID NO: 144351 - DNA, 3709 bp, Homo sapiens
  Payload ID: 8519
  Gene Symbol: INVS
  Gene Name: inversin
  Uniprot ID: Q9Y283
  ENST ID: ENST00000262457
  CDS Start-End: 186-3383
gccgaaagcctcgggcggccttttgaggggctcggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaagggaaattatcgtttcatgaaactcttacttacacgcagagcaaactggatgcaaaaggatctggaagagatgactcctttgcacttgaccacccggcacaggagccctaagtgtttggcacttctgctgaagtttatggcaccaggagaagtggatacacaggataaaaacaagcaaacagctctgcattggagtgcctactacaataaccctgagcatgtgaagctgctcatcaagcatgattctaacattgggattcctgatgttgaaggcaagatcccacttcactgggcagccaaccataaagatccaagtgctgttcacacagtgagatgcattctggatgctgctccaacagagtctttactgaactggcaagactacgagggtcgaactcctcttcactttgcagttgctgatgggaatgtgaccgtggttgatgtcttgacctcatatgaaagctgcaatataacgtcttatgataacttatttcgaaccccactgcactgggcagctttattaggccatgcacagattgtccatctccttttagaaagaaataagtctggaactatcccatctgacagccaaggagccacacctttgcactatgctgctcagagtaactttgctgaaacggttaaagtgtttttaaaacatccttcagtgaaagatgattcagacctggaaggaagaacatcctttatgtgggcagctggcaaaggcagtgatgatgtccttagaactatgctgagcttaaaatcggacatagatattaacatggctgacaaatatggaggtacagctttgcatgctgctgctctttctggccatgtcagcaccgtgaagttattactggaaaataatgctcaagtagatgctactgatgttatgaaacatactccacttttccgagcctgtgagatgggacacaaagatgtgattcagacactcattaaaggtggagcaagggtagatctagttgaccaagatggacattctcttctacattgggcagcactgggaggaaatgctgatgtttgccagatattaatagaaaataagatcaatccaaatgtccaggattatgcaggaagaacccctttgcagtgtgcagcatatggaggctatatcaactgcatggcagttctcatggaaaacaatgcagaccctaacattcaagacaaagagggaagaacagctttgcattggtcctgcaacaatggataccttgatgccattaaattactgctagactttgctgctttccctaatcagatggaaaacaatgaagagagatacacaccccttgattatgctttgcttggtgagcgccatgaagtgatccagttcatgttggagcacggtgccctgtccatcgcagccatacaagacatcgccgccttcaaaatccaagctgtctacaaagggtacaaggtcagaaaagccttccgagacaggaaaaatctcctcatgaagcatgaacagttgagaaaagatgctgctgccaaaaagcgagaggaagaaaacaaacgaaaagaggcagaacagcaaaaaggaaggcggagcccagattcctgcagaccccaggcccttccctgtctgcctagcacccaggatgtgcccagcaggcagagccgggcccccagcaagcagcctcctgctggcaacgtggcccaaggccctgagccaagagacagcagaggatctccaggagggtctctaggcggagccctccagaaggagcagcatgtttcctcagatttgcagggaacaaactccagaaggccaaatgaaacagccagagaacattctaaaggccaatctgcttgtgtccacttcagacccaatgaaggcagtgatggaagcaggcatccaggagttccctctgttgagaagtccagaggtgagacagctggcgatgagcggtgtgcaaaggggaaaggcttcgtgaagcagccctcctgtatcagggtggctgggcctgatgagaaaggagaggactccaggcgggcagctgcaagccttccaccgcacgatagccactggaagcccagcaggcggcatgacacagaacccaaggccaaatgtgccccccagaaaaggcgcactcaagagctcagaggaggaaggtgctctccggctggttctagccgccctggcagtgcccggggggaggcggtccatgctgggcagaatcctccccaccatcgtacaccaagaaacaaagtgacacaagccaagctcacaggagggctctattcacatttgccacagagcacagaggagttgaggtcaggagctaggaggctggagacatctaccctgtccgaggactttcaggtatctaaggagactgatccagcacctggtcccctctctgggcagagtgtgaatattgaccttctccccgtagagctccgactgcagataattcagagagaacgaaggaggaaggagctgtttcgcaaaaagaacaaggcagcagcagtcatccagcgcgcctggcgaagctaccagctcaggaagcacctgtcccaccttcggcatatgaagcagcttggagctggagatgtggacagatggaggcaagagtctacagcattgctcctccaggtttggaggaaggaactggaactaaaattcccccaaaccactgcagtaagcaaggcccccaagagtccatccaagggcacctcaggcacaaagtccaccaagcactcagtgcttaagcaaatctatggttgttctcacgaagggaaaatacatcatcctacaagatctgtaaaagcctcttctgtgctgcgtctcaactcagtgagcaacctacagtgtatacatctccttgagaacagtggaagatcaaagaacttttcttataacctgcaatcagctactcagccaaaaaacaaaacaaaaccttgactgcctatggaggaagactgtgttcgggggagctggcatagctagtgcagagttcagattttctgctgataatcttttacaccttgggaaaactttaatatccgtacctgaaggctgattcacctaaaaatgtgttaactgaaagaaaatgtcagaatgtttcctttctgctcttacacagcattgttttgtcaatcaacacagcctgcactgaaaggacctgcatagactatgtctgtgcaaagtgcctgagtgtctgctttcacctcagtctgtacagttggaaatgagaattcataattaacagcaaaatctaaggaaaacta

SEQ ID NO: 144352 - DNA, 1654 bp, Homo sapiens
  Payload ID: 8519
  Gene Symbol: INVS
  Gene Name: inversin
  Uniprot ID: Q9Y283
  ENST ID: ENST00000374921
  CDS Start-End: 154-459
cggctagcttcagcgccgtggggtctgacctggctggatatagtgtaccggcccggcaggaggggcggcccggtccgggttgcgcctcctggagccgcccccgggacgtcagtcctggaggaggcgagggttgctccggttgctaagaagactatgaacaagtcagagaacctgctgtttgctggttcatcattagcatcacaagtccatgctgctgccgttaatggagataagggtgctctacagaggctcatcgtaggaaactctgctcttaaagacaaagaagatcagtttgggagaacaccacttatgtattgcgtgttggctgacagattggattgtgcagatgctcttctgaaggcaggagcagatgtgaataaaactgaccatagccagagaacagccctccatcttgcagcccagaaggcattgagaacaatcagcacaggcaggatctaagagactacaatcattcaaagaagagaaacacgtaaagtgagtaccacattcatcctggccttttcctttatgacattttccaaactggaatgcaaaagaatacaaccctaacaggaagcagcagccttaccaggctgaagaaactgaggcagagtttggagataatagtggctggaacttgaaagtcaaaatcctggagaggagggaattgcagagaaagaatgcaagaatctggatacaaattcctcacaagtttttaacagattcctaaactgtgcttgtatagggtggtgctctaagaaacctagtattaaacaacagctgggagactagacagctgagtagagattattttaaattatcctatattttcttttatgtttaaatctcttaatatataacacattgatttttgtatggggatccattctcattttaaagcatatggataactaattttcccaacacaacctagttcattaatttttggccatttagtatctgctctctgtcagttccaggcttttgtactacgaactccctatgcatttctgtttttttaaatgagggatcctgaatactagggagcctttgggaaatttgaaaataaaagttacatgatcagtgtattttagggggactaatatggcaactaaagctactttggaagagaaagagtggagatacatagattgctattatagttcaggccaatagagaggaattgggtttaagagatacattatggaggcagaagtgttcattcaacaagcgtttgttaaatatctactatgtaatcatgattatacaactagagagaatatgaaaaaaatgaattacgtatgttagcttatagatggatgctctcagtacccatccctattaatcgtcatttccctttgtttagtgaaccttctgatatattggatatcaaatatcctttccaagtattgtctgtcccacttaattctggtatccatgaatgcagaagtgtgctatttatgtaatcatgaacactcatgtatatgtgtataccttcattcattcaacatgtgttaaaactattatgtaacaggcatcatgttaggccttggaacacaaaggtgaacaacatgattcctgctcttaagttgcttacaaagatcatggatgaagatattaaatgataattaaagctgattgatctaccttgtaa

SEQ ID NO: 144353 - DNA, 3050 bp, Homo sapiens
  Payload ID: 8520
  Gene Symbol: INF2
  Gene Name: inverted formin, FH2 and WH2 domain containing
  ENST ID: ENST00000252527
  CDS Start-End: 1-2154
ggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaagaacattcctgcccctttttgtcttgtatgacattgacgttctggaagataacttcactttgggtttgcctgattgcgcccccaagcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 144354 - DNA, 7578 bp, Homo sapiens
  Payload ID: 8520
  Gene Symbol: INF2
  Gene Name: inverted formin, FH2 and WH2 domain containing
  Uniprot ID: Q27J81
  ENST ID: ENST00000330634
  CDS Start-End: 144-3866
cgccccgcgcccgccaggagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcgagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctagcccggtgtgcgactgtcgtgttcagaggctgcgggagtgggcggtggacgtgggctcccacaaacatggtgagcgctggacaggccccgtgtgaacactcactgttgaggggcccccaggccccgtgtgaacactcactgttgaggggtccctgggcccccaggcaccgtgtgagcattcactgttgagggtcccccagtcccccaggccaggggctgtccctggagccctcaggaggcagtaagaaacatctagaagagggcagacccagtggtgaaccgcatccaacagtggtgagatgggtgcagctctacaggggcgtaatttacaaaccaccagactccctggttatgtgtgtgctgcggtggtgtttgctctccagcagatcaagtttgtgcaatgatccattttgagaatctctccgtcaccccaagaagtcctctcgcacccatcagtccgaccccttccccgtgctcctccccagccctggcagccactcacctgcactccagacgctccagatgtcatgcatgtctcctggcttccttcggctgttttcacgcgccatcctcacggcaggctgtatcaggacttcattccatttcatggctgaagcacattccattgcatgcagggaccacattttgtttgtctgctcttctgtccatggacatctgggttgcttccagtttggggcttctgtgaatcctgctgctgtggacatttgcgtagtcctcgtgtggatgctgctgtggacgtctgcgtcgtcctcgtgtggatgctgctgtggacgtctgcgtcgtcctcgtgtggatgctgctgtggacgtctgcgtagtctcgtgtggatgctgctgtggacgtctgcgtcgtcctcgtgtggatgctgctgtggacatctgcgtagtctcgtgtggatgctgctgtgaacgtctgcgtagtctcgtgtggatgctgctgtggacgtctgcgtagtctcgtgtggatgctgctgtgcacgtctgcgtcgtcctcgtgtggatgctgctgtggacgtctgcgtcgtcctcgtgtggatgctgctgtggacgtctgcgtcgtcctcgtgtggatgctgctgtggacgtctgcgtcgtctcgtgtggatgctgctgtggacgtctgcgtcgtctcgtgtggatgctgctgtggacgtctgcgtcgtctcgtgtggatgctgctgtggacgtctgcgtcgtcctcgtgtggatgctgctgtggacgtctgcgtcgtctcgtgtggatgctgctgtggacgtctgcgtcgtcctcgtgtggatgctgctgtggacgtctgcgtcgtcctcgtgtggatgctgctgtggacgtctgcgtcgtcctcgtgtggatgctgctgtggacgtctgcgtcgtcctcctgtggatgctgctgtggacgtctgcgtcgtcctcgtgtggatgctgctgtggacgtctgcgtagtctcgtgtggatgctgctgtggacgtctgcgtagtctcgtgtggatgctgctgtggacgtctgcgtcgtcctcgatgctgctgtggacgtctgcgtcgtcctcgtgtggatgctgctatggacgtctgcgtagtctcgtgtggatgctgctgtggacgtctgcgtcgtcctcgtgtggatgctgctgtggacgtctgcgtagtctcgtgtggatgctgctgtggacgtctgcgtagtctcgtgtggatgctgctgtggacgtctgcgtcgtcctcgtgtggatgctgctgtggacgtctgcgtagtctcgtgtggatgctgctgtggacgtctgcgtcgtcctcgtgtggatgctgctgtggacgtctgtgtagtctcatgtggatgctgcgagttttcgttgctctggggtagattcgtagcggaggaacaactgggcgacacgctaagtttatgtttaactttttaagtaactgcctaactgttttccaaagcagctgcaccatttttcattcccatccatgctattgtttttcagttaaatagctccactcctccccctccccaccctccacagaactgccagtaaaactggactatggagtattgggtggggtcacctacaaggtcatctgcagcaagtgagaccatcgcccctcctgcctggagaggtgggactggggaccctgtgacaggaggagctgcccttcctggagcctggtttttctttttcctctgtgctccatgagaagtcagtttagtgggctacagccagcaaaggaaccaaaaccaacaggagctctgggggtgccttgcatggcgaggctccgtggctgcacgcgtgtatgcaggtggctgtgggtgtctgtgtgtcctgggccactgtgtgcgatggtcccactgggaggtgtggcccccaaagagtggaacccacaggtggacacacccatgcaccctcgttcttgcccaaggtcacacatcgagacagcagggcccagatggatggccccaagctcggtggctcccgtgctgcccacacctggggacaggcccactgtggggggtaaggggtggaggtgttctaattcgggctgagccgtgtgactggcaggggccccagctgttgggcctgggcaggactgtttttagaaaagccccaactccctgcccctacccgggcccgtggctatttatagtccgggcctggagaagtcagtgagtcactagcgttcgcctctgcagggtcagtccaagcccccttagtgaggtggtctagcatgtcccccagtcccccaagcctctatctgacatctgctagcccagagccccaggggtccccaggaagggctcagagctggtggccccccccaggccttggcagcacctccttgtctgatgggactttgtggttcctggtggacatttaacattgtcggtttctctcatctggaaacaaacctccatgacgctc

SEQ ID NO: 144355 - DNA, 4672 bp, Homo sapiens
  Payload ID: 8520
  Gene Symbol: INF2
  Gene Name: inverted formin, FH2 and WH2 domain containing
  Uniprot ID: Q27J81
  ENST ID: ENST00000392634
  CDS Start-End: 113-3862
gccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcgagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatgcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacct

SEQ ID NO: 144356 - DNA, 1689 bp, Homo sapiens
  Payload ID: 8520
  Gene Symbol: INF2
  Gene Name: inverted formin, FH2 and WH2 domain containing
  Uniprot ID: Q27J81
  ENST ID: ENST00000398337
  CDS Start-End: 129-833
aggagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccaggccctggacacatccaacgtgatggtgaagaagcaggtgtttgagctactggctgccctgtgcatctactctcccgagggccacgtgctgaccctggacgccctggaccactacaagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcgggctgcagctgctggacgtcctggctcgcctgcggtgagtccccactgtagcggtcctgccggctccccctcctgctcccaaggccaggcccacctgccctttggctcccagccacctcacctaagcagcacctccagatggcagggaggtggctccctcggagtaaccccaggggtccagccagaagccaggtctcaggctagaatccagctcactgtccctggcagctgcccacagaaactagggttgcagcagccatagaaaggacagaatgagctcatatcctttgcacaccgtggatggagctggaggccgtgatcctaagtgaaccaacccagaaacagaaaatgaaatgccaataagagggaactacagggtggttcacgtggacgcaagatggagacagggacacgggctccagggcgagagttgaaaaactacctacagggtacagtgttcgtcgctacttggtgtcaggcccactagaacaagggtccccaaccgccaggctgcggaccggtacctggcctattggaaccgggccacgcagcaggaagtgagcggtgggcgggcattcctgcctgagctgcacctcatgtcagatcagcactgcattagattctccagcgcacgcacgcgcgcaagggatccaggctgcgcgctcctcatgacaatctaatgcctgatgatcgggggtggaacagttttatccctaaaccattcccgtcaccccagtctatggaaaaattgtcttccacaaaaccagtccctggtgccaaaaaggctggggaccactgccctagaaggcaaatcgcctacgttacacagtgtaccatgtggcaaacacgcacatgtacccccgagtctaaaataaaaattttttaaaaaagaaa

SEQ ID NO: 144357 - DNA, 2956 bp, Homo sapiens
  Payload ID: 8520
  Gene Symbol: INF2
  Gene Name: inverted formin, FH2 and WH2 domain containing
  ENST ID: ENST00000617571
  CDS Start-End: 2528-2956
ggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagtgagctccccatcccacctggtgccaggggctggtgagactcactccctgcccctcccagggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 144358 - DNA, 2153 bp, Homo sapiens
  Payload ID: 8521
  Gene Symbol: IVL
  Gene Name: involucrin
  Uniprot ID: P07476
  ENST ID: ENST00000368764
  CDS Start-End: 65-1822
tcagcactccaccaaagcctctgcctcagccttactgtgagtctggttgacagtagcttctaagatgtcccagcaacacacactgccagtgaccctctcccctgccctcagtcaggagctcctcaagactgttcctcctccagtcaatacccatcaggagcaaatgaaacagccaactccactgcctcccccatgccagaaggtgcctgtcgagctcccagtggaggtcccatcaaagcaagaggaaaagcacatgactgctgtaaagggactgcctgagcaagaatgtgagcaacagcagaaggagccacaggagcaggagctgcagcaacagcactgggaacagcatgaggaatatcagaaagcagaaaacccagagcagcagcttaagcaggagaaaacacaaagggatcagcagctaaacaaacagctggaagaagagaagaagctcttagaccagcaactggatcaagagctagtcaagagagatgagcaactgggaatgaagaaagagcaactgttggagctcccagagcagcaggaggggcacctgaagcacctagagcagcaggagggacagctgaagcacccggagcagcaggaggggcagctggagctcccagagcagcaggaggggcagctggagctcccagagcagcaggaggggcagctggagctcccagagcagcaggaggggcagctggagctcccagagcagcaggaggggcagctggagctcccagagcagcaggaggggcagctggagctcccacagcagcaggaggggcagctggagctctctgagcagcaggaggggcagctggagctctctgagcagcaggagggacagctgaagcacctggagcaccaggaggggcagctggaggtcccagaggagcagatggggcagctgaagtacctggaacagcaggaggggcagctgaagcacctggatcagcaggagaagcagccagagctcccagagcagcagatggggcagctgaagcacctggagcagcaggaggggcagcctaagcatctggagcagcaggaggggcaactggagcagctggaggagcaggaggggcagctgaagcacctggagcagcaggaggggcagctggagcacctggagcaccaggaagggcagctggggctcccagagcagcaggtgctgcagctgaagcagctagagaagcagcaggggcagccaaagcacctggaggaggaggaggggcagctgaagcacctggtgcagcaggaggggcagctgaagcatctggtgcagcaggaggggcagctggagcagcaggagaggcaggtggagcacctggagcagcaggtggggcagctgaagcacctagaggagcaggagggacaactgaagcatctggagcagcagcaggggcagttggaggtcccagagcagcaggtggggcagccaaagaacctggagcaggaggagaagcaactggagctcccagagcagcaagagggccaggtgaagcacctggagaagcaggaggcacagctggagctcccagagcagcaggtaggacagccaaagcacctggaacagcaggaaaagcacctagagcacccagagcagcaggacggacaactaaaacatctggagcagcaggaggggcagctgaaggacctggagcagcagaaggggcagctggagcagcctgtgtttgccccagctccaggccaggtccaagacattcaaccagccctgcccacaaagggagaagtattgcttcctgtagagcaccagcagcagaagcaggaggtgcagtggccacccaaacataaataaccacccgcagtgtccagaggccctcagatcgtctcatacaagggaagagagagccactggctccacttatttcgggtccgctaggtggcccgtctcatctgtgaacttgactctgtccctctacatgtctctttaatggggtgagggtgggggagagagggaattattgtccagtgccaaccccaatgaccccaatcccaacctcaggtgagcagagcctctacttgagggactattgttactataggaatccttacttccccagtattgaagctgaatcagtgagtgtgtacaatgatacataataaatcctggaagtcttgggatccta

SEQ ID NO: 144359 - DNA, 7513 bp, Homo sapiens
  Payload ID: 8522
  Gene Symbol: IYD
  Gene Name: iodotyrosine deiodinase
  Uniprot ID: Q6PHW0
  ENST ID: ENST00000229447
  CDS Start-End: 141-1022
gaagagttctgcactttgttccttccctggcacacctgtgtctgcattccttctatctcccggcattctccactcctgtctctgtgtgtttaaaaaccggtgtgggaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtaaataatggaatcaccatgcggcatcagactgcgaggcaccgccacctgattgagggtcctggaagaagcagcgaagcctgcagcaagctcagctcacaaggctgcccagaatgcaggtctggtgactgtcactaccactcctctcaactgtggccctcgactgagggtgctcctgggccgccccgcacatgaaaagctgctgatgctgctccccgtggggtaccccagcaaggaggccacggtgcctgacctcaagcgcaaacctctggaccagatcatggtgacagtgtaggcagggccccccaagggagtggcagggagatggcgcccctgcttttccctgagcctctcgcctgctcctcttgggtctcttggctgctctttctccaggtgtcaggtcccctcattgctcttctcaggtggccacactatgtcaagaagcctctccacactctgtggcacttccagtcccataaatcctgtttcttatccactttggaaatgcatgaacactttacaaagaacatgcccgggtttttacattttaaaagttattctagacaatcactattggcttttttcttttatttttaaaaaactcacatagaggagacaatcagaaatttaccatagtcccaagaattcagctacatgatgactcgaatttaaatttagattaatcaaatggtctcctgttctctgatttctggtggcttttagacactaatttttgagaactacttttttttttttaccaaacttcagggacactctgctagttttgaataagtaaccatcaaagttactaaaacatggccaggcgcagtggctcatgcctgtaatcccagcactttgggaggccgaggtgggcagattgcctgagctcaagagttcgagaccagcctggccaacatggtgaaaccccatctctactaaaaatacaaaaaattagctgggcatgcacttgtaattccagctactcaggaggctgaggcaagagaactgcttgaatccgggaggtagagattgcagtgagtcaagatgctgagatgccaccactgcactccagcctgggcaacagagcgagaacctgtctcaaaaaaaacaaaaacaaagttactaaaatgtcaccttcacagaacaggacagggtacccttgggtcgcacgggcctggctggcatgtaaacggtcagttgcactgcctagtggtttggtagatctgacttgtaagcagttcatagaagctgctcaatactcaagaatcttgcaagacagttattaaacattcatagcttgaaattgcccatggtgggagagtttacatcacaaccactacaaatcagcacttgctttcttcttcttaaagagagctgcttaccatacatagcacccacagtgtctcccttctcttctaccccaacccctgaaacacactgacccctattctccagatgacagcacagctgtttgggactgatagggtcacagttgccaggttgggaatgctagatgtagtcttcacccatcaccttctgtcgtcctcccaggggtgtcatatttacagaggcaaactcttacagcttggatgatttctcatcaagcaactctactcacctctttttcccctttccctgtgcgtttcttcttcttgtcctcattttccttgagaaaactctctctataaaaaatttccatagagtatgtggctgataaacaacagaaatttgtttctcacagttctggaggctggaagtccaaggtcggggtgccctcatggtcaggtgctggtgaggaccctgatctgggttgcagactgctgacttcttattgtgtcctcgtggtagaaagagggttagagcctctggcatgccttttataagggtactaatcccatcatgaggccccgtccttatgacctcatcacctcccaaaggaccccctcctaataccatcacattgggggttagggtttcaacatatgaattgcgggggacacaaacattccgtccatggcacctacttcatagggtttggcatgctgctcggtacatggttaacattcataaatggtgggggcccttactgtggtagaaaccattgtcactgcaaggcagccctgcttgggattcaggtgaacaaatgtaacgtgggtgggtgagggactccctcctcttcagagaagccctcctgtggctcaggggcagctgcagggccagatggagttggcctgcagggagtcagccttaccccatcagagaccaacttgaaagatttttttctctgtgtagttcgtgttatcaatctgatctgcagccaggttatttacttctgaagcattggagttatcgattgccattgccccatggttctcactctttgcaggcactcttcaaatttttattttaaaaattataatgcaaacatctggccatcaccttaaccaagtgacaaagtcctagcacaccattaatggtaggataactgacattaagtgttcctgctgggatgaattatgaagtattccttccaaagatgtcaatggaaactaatcgagtcttacacctaattttcagtttacagtaaatacagaggataaagaagttaatggcatggtggaataaccaaaatgtgtatcattctacaaaaaaataggcctggactatttaaggagtgagtgtcactgtgggaagaataagagggggactgtcttgtccttgctactcaaagagtggtcctgggcctgtatcatcattgggaccacctgggcgcttgttagaatcaaagactctcaggcctcacctagacatccagaatcaaaatctgcattttaacaagatgcccaggtgatctgcatgcctgttaaagtctgagctctgttgcagataaccagagacccaacaaccaaaggcaaagcgtaagccttgattggattttggtttaggaaaaatctcataggtataaaagacaactgggaatgttgaatgtggatctggtggtaggtgatattgttagtgatgtgagtgatgcctgctgaagtactgagagatgaagcatcatattgacaacttactccaggaaaaaaggtgtgtgtataggtgtgtgtttggagagtgtgagcgagaactaacatggtaaaatgttaggtggagcatatacagttctcattatactcttattttaaatttatatttgaacacagtcaaatctgaatggaaatacatttaaataagcatttctttcagtcatataagtaatttgcctaaaaatgccctctaagtccatcattaggttaagcgatttactgaaggtgcagatatcatgcttatttcattgggttgttttggaatgtcccccacttggagagtttgaggaatggaaatgagaatcggaggagaaataaggccagaggctcacattgcttgcagggaaccgactgagtaatgaagaagaggaaggaagcccttggaaggaacgtaaaatccatttcagcctgccgccccttggaatggagggtcttctagggaccagaaacaccagacacttcttctgccccaagcacaccccacactaatttctgctgcagcatcacgatcagggcaaatcagcacagccccccagccatcagtggtgtctagaaaagtaaggataattttcttccttctcactgcagccccaagctcttattaaccttcttttatgtgttcattaaatgcagtcatgtgacaactgtgttcaaagttagaaatagtggtcggggaggcttatagatcctcttgctgttctgaggccttaaaaccaaaaaaataatggaatgattgcatcactgcgaggaagtatacttaattaagaaagttgaaaatggtttgtgtcttactaataggactcacctgaagactctactttgccaagagggaatttttaactcaaagttgtgtcagccagcacggggtagagccatggtcctcatacttgctggcatccctcatctggtggtctgttaaagcacagattgctgggccgcaccctcagggtgtgtgattgtgtgattcagtattgctgggtggtgcccaaatgctccagttctaatgtattcccaggtgttgctgatgctggtgattgggtaccacattttgagaaccatggggcattggcaatcaacaaatgcaatgcttgtgacttgacgtgataaaagttcatttattgggcaggcaaagtcctctgcaggcctggaaaccctccgagacaattacttgcatggggtaacccagtaatactgtgggatgcaacttctagggcatggctgcctccttcctagaggcagcagggggagaaaacactggaagaggtcaccccaacaattccatcgtaccttggcctaggagtgacctcctcagtctcacaaccctttggctagaactagtcatgtgacctcacaggaggtggagcagtgtcgtcaatgttatcatccccctgcacctgcaaggaaggaggcccagatgtgtgtaggtgctggatgtctcttccccaaaacatataactctggatttggaaaacaaaactggatataacagaaaagaaaaggaggggagaaggaaagttgaagaaattggtgaaatcagaataggacagtgaaaggcataaagattttcttctgaaacgctaagatcggttgatatttgtctaatacagctttaaatagagtatcactttgggccaaagaaaattgatataaacatacataaagtggaactaagattgacttcttcctagacatctctgcctctgtccacaaaatggaaacttccatcaaggagtactggaggacagttcagtatttcttcttatttgctcctccctatgaaaggaagagtgacttctctgctgcatgatattgggggtaaatagttattgcacatttgctcaaaccccagcaaagtgcaccccattttaagccaaatttacaaacttacaaagatgatccaccaatagttttctctatttactttattcttgctctgtcacccaggctagaatgcagtggtgtgattatagctcactgcagcctccaacttctggactcaagtgatcctcccaccttagcttcccaggtagctgggatacaggtgcacgccaccacacccaggctagtttttctaaatattggagttcccaaagagtattcaaactgatgtgatattttaaaagacattttgtaagcatcttttaggaatatcagtaagtggaagaaaaacacatagttatcagtggatattatgccagagaggcatgagaaatataattttattttgctaggtatcagcagagtgccctcttataatttgtgtgaaatggaaacaaaggtaacatcgtgttttcaattcacacatatatacaagtaatgagaggtccagaagaaatgtggcttcagctctgctgctactgtgcctcccttctcctgccccactcagcccacaaaataggctggacactcaaaaaacgttgcgtttatctaccttttagagagggtgaatagcagagaactggaggtgggaatggtaaggaactcccagcagggtagtggagggaatgggctgacgcatctaaggctgatgccaggtctgctccctatctgggtggcctcagcaaatgacgtccagcacatccaggggcaggctcaagggagaacagcccccaaagctaagatcctgccaagctaaatacagtagttctaatgaaatgtgagaggctataatcccatttgggaaattcctaaaaagtcatgaggcaggggattggtttatgttattatcatgacctgagagtcatggctcagagccaaatgttcaggattgaattcaacagcatttaaatgtctttagagcaggatggaaatatgttagcaatgcctgcagagtgccaagtaaacgcaaaagccaatgagatcataaaggaagttgttagctaacctaggtggagtcgccaacttccttctactctaataattaaaaataaaaataatacttgggaggtaactggaataaaggttctaaaatcaaaaccctctgaagggtgaaaactgggagcctcctgttcccatagtaaccacagcactcagggcactgtctcccagcgctggagtactgtcttatgaccagagatcctaagcaacctctgctcatctgagttgtccaccatattgtgggcatgagtccttgacaatagtaaatagcacctctgttcccttattgggtaaatgattttccaactctgggaatgtgtagaattcattatggaaataatgcaataattcaaatccataatattgatactttcatgttaagtttaggactaatcttgtgtatgctccttaagtgatttgaatctttaaaaagcttatgattccaatttgaaatgtgaaattgattttacgtttgtgatttgaagttgaaaggtataagaatatttaacttagctcatgaaaagtattagactagatttactataagtttaatgtattagatttacaagagatgcttaaatatatgagaatgttttgtcttaattggttataatcttgtcatatcaatgatttgaagtgctaaaatagaaaattaaatatgataaattacacaagaagtttagaatgtttaaaagattttaataaacaaagcctataactaag

SEQ ID NO: 144360 - DNA, 8742 bp, Homo sapiens
  Payload ID: 8522
  Gene Symbol: IYD
  Gene Name: iodotyrosine deiodinase
  Uniprot ID: Q6PHW0
  ENST ID: ENST00000344419
  CDS Start-End: 141-1010
gaagagttctgcactttgttccttccctggcacacctgtgtctgcattccttctatctcccggcattctccactcctgtctctgtgtgtttaaaaaccggtgtgggaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcagaatgcaggtctggtgactgtcactaccactcctctcaactgtggccctcgactgagggtgctcctgggccgccccgcacatgaaaagctgctgatgctgctccccgtggggtaccccagcaaggaggccacggtgcctgacctcaagcgcaaacctctggaccagatcatggtgacagtgtaggcagggccccccaagggagtggcagggagatggcgcccctgcttttccctgagcctctcgcctgctcctcttgggtctcttggctgctctttctccaggtgtcaggtcccctcattgctcttctcaggtggccacactatgtcaagaagcctctccacactctgtggcacttccagtcccataaatcctgtttcttatccactttggaaatgcatgaacactttacaaagaacatgcccgggtttttacattttaaaagttattctagacaatcactattggcttttttcttttatttttaaaaaactcacatagaggagacaatcagaaatttaccatagtcccaagaattcagctacatgatgactcgaatttaaatttagattaatcaaatggtctcctgttctctgatttctggtggcttttagacactaatttttgagaactacttttttttttttaccaaacttcagggacactctgctagttttgaataagtaaccatcaaagttactaaaacatggccaggcgcagtggctcatgcctgtaatcccagcactttgggaggccgaggtgggcagattgcctgagctcaagagttcgagaccagcctggccaacatggtgaaaccccatctctactaaaaatacaaaaaattagctgggcatgcacttgtaattccagctactcaggaggctgaggcaagagaactgcttgaatccgggaggtagagattgcagtgagtcaagatgctgagatgccaccactgcactccagcctgggcaacagagcgagaacctgtctcaaaaaaaacaaaaacaaagttactaaaatgtcaccttcacagaacaggacagggtacccttgggtcgcacgggcctggctggcatgtaaacggtcagttgcactgcctagtggtttggtagatctgacttgtaagcagttcatagaagctgctcaatactcaagaatcttgcaagacagttattaaacattcatagcttgaaattgcccatggtgggagagtttacatcacaaccactacaaatcagcacttgctttcttcttcttaaagagagctgcttaccatacatagcacccacagtgtctcccttctcttctaccccaacccctgaaacacactgacccctattctccagatgacagcacagctgtttgggactgatagggtcacagttgccaggttgggaatgctagatgtagtcttcacccatcaccttctgtcgtcctcccaggggtgtcatatttacagaggcaaactcttacagcttggatgatttctcatcaagcaactctactcacctctttttcccctttccctgtgcgtttcttcttcttgtcctcattttccttgagaaaactctctctataaaaaatttccatagagtatgtggctgataaacaacagaaatttgtttctcacagttctggaggctggaagtccaaggtcggggtgccctcatggtcaggtgctggtgaggaccctgatctgggttgcagactgctgacttcttattgtgtcctcgtggtagaaagagggttagagcctctggcatgccttttataagggtactaatcccatcatgaggccccgtccttatgacctcatcacctcccaaaggaccccctcctaataccatcacattgggggttagggtttcaacatatgaattgcgggggacacaaacattccgtccatggcacctacttcatagggtttggcatgctgctcggtacatggttaacattcataaatggtgggggcccttactgtggtagaaaccattgtcactgcaaggcagccctgcttgggattcaggtgaacaaatgtaacgtgggtgggtgagggactccctcctcttcagagaagccctcctgtggctcaggggcagctgcagggccagatggagttggcctgcagggagtcagccttaccccatcagagaccaacttgaaagatttttttctctgtgtagttcgtgttatcaatctgatctgcagccaggttatttacttctgaagcattggagttatcgattgccattgccccatggttctcactctttgcaggcactcttcaaatttttattttaaaaattataatgcaaacatctggccatcaccttaaccaagtgacaaagtcctagcacaccattaatggtaggataactgacattaagtgttcctgctgggatgaattatgaagtattccttccaaagatgtcaatggaaactaatcgagtcttacacctaattttcagtttacagtaaatacagaggataaagaagttaatggcatggtggaataaccaaaatgtgtatcattctacaaaaaaataggcctggactatttaaggagtgagtgtcactgtgggaagaataagagggggactgtcttgtccttgctactcaaagagtggtcctgggcctgtatcatcattgggaccacctgggcgcttgttagaatcaaagactctcaggcctcacctagacatccagaatcaaaatctgcattttaacaagatgcccaggtgatctgcatgcctgttaaagtctgagctctgttgcagataaccagagacccaacaaccaaaggcaaagcgtaagccttgattggattttggtttaggaaaaatctcataggtataaaagacaactgggaatgttgaatgtggatctggtggtaggtgatattgttagtgatgtgagtgatgcctgctgaagtactgagagatgaagcatcatattgacaacttactccaggaaaaaaggtgtgtgtataggtgtgtgtttggagagtgtgagcgagaactaacatggtaaaatgttaggtggagcatatacagttctcattatactcttattttaaatttatatttgaacacagtcaaatctgaatggaaatacatttaaataagcatttctttcagtcatataagtaatttgcctaaaaatgccctctaagtccatcattaggttaagcgatttactgaaggtgcagatatcatgcttatttcattgggttgttttggaatgtcccccacttggagagtttgaggaatggaaatgagaatcggaggagaaataaggccagaggctcacattgcttgcagggaaccgactgagtaatgaagaagaggaaggaagcccttggaaggaacgtaaaatccatttcagcctgccgccccttggaatggagggtcttctagggaccagaaacaccagacacttcttctgccccaagcacaccccacactaatttctgctgcagcatcacgatcagggcaaatcagcacagccccccagccatcagtggtgtctagaaaagtaaggataattttcttccttctcactgcagccccaagctcttattaaccttcttttatgtgttcattaaatgcagtcatgtgacaactgtgttcaaagttagaaatagtggtcggggaggcttatagatcctcttgctgttctgaggccttaaaaccaaaaaaataatggaatgattgcatcactgcgaggaagtatacttaattaagaaagttgaaaatggtttgtgtcttactaataggactcacctgaagactctactttgccaagagggaatttttaactcaaagttgtgtcagccagcacggggtagagccatggtcctcatacttgctggcatccctcatctggtggtctgttaaagcacagattgctgggccgcaccctcagggtgtgtgattgtgtgattcagtattgctgggtggtgcccaaatgctccagttctaatgtattcccaggtgttgctgatgctggtgattgggtaccacattttgagaaccatggggcattggcaatcaacaaatgcaatgcttgtgacttgacgtgataaaagttcatttattgggcaggcaaagtcctctgcaggcctggaaaccctccgagacaattacttgcatggggtaacccagtaatactgtgggatgcaacttctagggcatggctgcctccttcctagaggcagcagggggagaaaacactggaagaggtcaccccaacaattccatcgtaccttggcctaggagtgacctcctcagtctcacaaccctttggctagaactagtcatgtgacctcacaggaggtggagcagtgtcgtcaatgttatcatccccctgcacctgcaaggaaggaggcccagatgtgtgtaggtgctggatgtctcttccccaaaacatataactctggatttggaaaacaaaactggatataacagaaaagaaaaggaggggagaaggaaagttgaagaaattggtgaaatcagaataggacagtgaaaggcataaagattttcttctgaaacgctaagatcggttgatatttgtctaatacagctttaaatagagtatcactttgggccaaagaaaattgatataaacatacataaagtggaactaagattgacttcttcctagacatctctgcctctgtccacaaaatggaaacttccatcaaggagtactggaggacagttcagtatttcttcttatttgctcctccctatgaaaggaagagtgacttctctgctgcatgatattgggggtaaatagttattgcacatttgctcaaaccccagcaaagtgcaccccattttaagccaaatttacaaacttacaaagatgatccaccaatagttttctctatttactttattcttgctctgtcacccaggctagaatgcagtggtgtgattatagctcactgcagcctccaacttctggactcaagtgatcctcccaccttagcttcccaggtagctgggatacaggtgcacgccaccacacccaggctagtttttctaaatattggagttcccaaagagtattcaaactgatgtgatattttaaaagacattttgtaagcatcttttaggaatatcagtaagtggaagaaaaacacatagttatcagtggatattatgccagagaggcatgagaaatataattttattttgctaggtatcagcagagtgccctcttataatttgtgtgaaatggaaacaaaggtaacatcgtgttttcaattcacacatatatacaagtaatgagaggtccagaagaaatgtggcttcagctctgctgctactgtgcctcccttctcctgccccactcagcccacaaaataggctggacactcaaaaaacgttgcgtttatctaccttttagagagggtgaatagcagagaactggaggtgggaatggtaaggaactcccagcagggtagtggagggaatgggctgacgcatctaaggctgatgccaggtctgctccctatctgggtggcctcagcaaatgacgtccagcacatccaggggcaggctcaagggagaacagcccccaaagctaagatcctgccaagctaaatacagtagttctaatgaaatgtgagaggctataatcccatttgggaaattcctaaaaagtcatgaggcaggggattggtttatgttattatcatgacctgagagtcatggctcagagccaaatgttcaggattgaattcaacagcatttaaatgtctttagagcaggatggaaatatgttagcaatgcctgcagagtgccaagtaaacgcaaaagccaatgagatcataaaggaagttgttagctaacctaggtggagtcgccaacttccttctactctaataattaaaaataaaaataatacttgggaggtaactggaataaaggttctaaaatcaaaaccctctgaagggtgaaaactgggagcctcctgttcccatagtaaccacagcactcagggcactgtctcccagcgctggagtactgtcttatgaccagagatcctaagcaacctctgctcatctgagttgtccaccatattgtgggcatgagtccttgacaatagtaaatagcacctctgttcccttattgggtaaatgattttccaactctgggaatgtgtagaattcattatggaaataatgcaataattcaaatccataatattgatactttcatgttaagtttaggactaatcttgtgtatgctccttaagtgatttgaatctttaaaaagcttatgattccaatttgaaatgtgaaattgattttacgtttgtgatttgaagttgaaaggtataagaatatttaacttagctcatgaaaagtattagactagatttactataagtttaatgtattagatttacaagagatgcttaaatatatgagaatgttttgtcttaattggttataatcttgtcatatcaatgatttgaagtgctaaaatagaaaattaaatatgataaattacacaagaagtttagaatgtttaaaagattttaataaacaaagcctataactaagactgatgctttaagggagtttggcttattcaacttgagttaatcaaacattaattaaagccccccttccccaaagagatttgttttatttatttgtttactagttttataaataggataataaaatgtgtgtatgaggtcagaatgcttttgacagaagtaatacaaacaaaaaaacctcactataacccaaacaaataagggattatttttccctcctagtgagaagtctggaggtagatattagatgctggtctattgcttcaatgaagttagtgccaaagtctcagtggttctcttggtctttcttcataaccaccggatgctgttatagcttcaccaatcacaacaagcacagtgcttggaacataataggtgctcaataaatattcagtacatattgaatgtgtgcagaaatatatctcaatctagtcataaaattttagaatgcaagatctgaaagggacatgggaatctgtgtttttaacgtgttccaggtgattctgctgaccaggtgagtatggtaaatgtggcaagtattctcaagtgagctcatcagtcccagggctgttagcaccttccatctgccaggccctccctggtctagaccttcagccttgaccttgccctgaaacgccaaactcttactcccagctgctttctctgtccctccacttagatgttagtaggcaccacaaccttttaatgctcaaaatactacttttgagtcctttccaccccttacttggcccctcaattcatactttttgggatggagcctcaaatccagaaatcttctgtattagtccattctcacactgctaataaagaatacctgagactgagtaatttataaaggaaggaggtttaattgattcacagttcagcatggctggggaggcctcaggaaacttacaatcatggcagaaagaaaagcaaacatgcccttcttcacatggtgacaggaagcagaagaatgacaactgagtgaatggggaaaccccttataaagccatcagatctcatgagaactcactcattctcatgagaataacatgggggaaactgcccccattattcaattatcccccatcagttctctcccatgacatgtggggattatgggaactacaatgcaagatgagatttgggtgaagacatagccaaaccatatcatcatcttaaatttctgtgattcttttattctgcacatccaaatccatgagcaagttatactgactttatctctgaatattgaccatgggaggggaacaaggagaagcagtgtgaacaggaaaagcatgctgcctgctgctgtgaataataacatatcttgctctga

SEQ ID NO: 144361 - DNA, 994 bp, Homo sapiens
  Payload ID: 8522
  Gene Symbol: IYD
  Gene Name: iodotyrosine deiodinase
  Uniprot ID: Q6PHW0
  ENST ID: ENST00000367335
  CDS Start-End: 80-823
ggcattctccactcctgtctctgtgtgtttaaaaaccggtgtgggaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtttttggaaaaattatcctgaaggagctggcattgatttccttcctgaatctgtaagcaggtaaataatggaatcaccatgcggcatcagactgcgaggcaccgccacctgattgagggtcctggaagaagcagcgaagcctgcagcaagctcagctcacaaggctgcccagaatgcaggtctggtgactgtcactaccactcctctcaactgtggccctcgactga

SEQ ID NO: 144362 - DNA, 1180 bp, Homo sapiens
  Payload ID: 8522
  Gene Symbol: IYD
  Gene Name: iodotyrosine deiodinase
  ENST ID: ENST00000392255
  CDS Start-End: 36-848
gaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtaaataatggaatcaccatgcggcatcagactgcgaggcaccgccacctgattgagggtcctggaagaagcagcgaagcctgcagcaagctcagctcacaaggctgcccaggtttctactgctagagacatacaaaattcagtatggagtaaaagctatgtcttgaaaaggaccaagatataaaatgacactaaattaaggtgtaaatattttctcaaaaaagtttaagacttggccaggtgcggtggctcacgcctctaatcccagcactttgggaggccaaggcgggcggatcacgaggtcaggagatcgagaccatcctggctaacatggtgaaacccggcctttactaaaaatacaaaaaatgagccaggcgtggtggcgggcgcctgtagtcccagctactcgggaggctgaggcaggagaatggcgtgaacctgggaggcggagcttgcag

SEQ ID NO: 144363 - DNA, 882 bp, Homo sapiens
  Payload ID: 8522
  Gene Symbol: IYD
  Gene Name: iodotyrosine deiodinase
  Uniprot ID: Q6PHW0
  ENST ID: ENST00000392256
  CDS Start-End: 80-823
ggcattctccactcctgtctctgtgtgtttaaaaaccggtgtgggaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtttttggaaaaattatcctgaaggagctggcattgatttccttcctgaatctgtaagcagaatgcaggtctggtgactgtcactaccactcctctcaactgtggccctcgactga

SEQ ID NO: 144364 - DNA, 684 bp, Homo sapiens
  Payload ID: 8522
  Gene Symbol: IYD
  Gene Name: iodotyrosine deiodinase
  ENST ID: ENST00000425615
  CDS Start-End: 24-602
ggccaccttgagaagaagaggtgatgaaggaggcagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtttttggaaaaattatcctgaaggagctggcattgatttccttcctgaatctgtaagcaggtaaataatggaatcaccatgcggcatcagactgcgaggcaccgccacctgattgagggtcctggaagaagcagcgaa

SEQ ID NO: 144365 - DNA, 551 bp, Homo sapiens
  Payload ID: 8522
  Gene Symbol: IYD
  Gene Name: iodotyrosine deiodinase
  ENST ID: ENST00000422583
  CDS Start-End: 1-270
ccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcagaatgcaggtctggtgactgtcactaccactcctctcaactgtggccctcgactga

SEQ ID NO: 144366 - DNA, 2158 bp, Homo sapiens
  Payload ID: 8522
  Gene Symbol: IYD
  Gene Name: iodotyrosine deiodinase
  ENST ID: ENST00000500320
  CDS Start-End: 36-890
gaagtgtgcacgcctgtgacgtcagactccagaccatgtatttcctgactcccatcttggtagccattctctgcattttggttgtgtggatctttaaaaatgccgacagaagcatggagaaaaagaagggggagcctagaaccagggccgaagctcgcccctgggtggatgaagacttaaaagacagcagtgacctgcaccaagcagaagaagatgctgatgaatggcaagaatcagaagaaaatgttgaacacatccccttctctcataaccactatcctgagaaggaaatggttaagaggtctcaggaattttatgaacttctcaataagagacggtcagtcaggttcataagtaatgagcaagtcccaatggaagtcattgataatgtcatcagaacggcaggaacagccccgagtggggctcacacagagccctggaccttcgtggttgtgaaggacccagacgtgaagcacaagattcgaaagatcattgaggaggaagaggagatcaactacatgaaaaggatgggacatcgctgggtcacagacctcaagaaactgagaaccaactggattaaagagtacttggatactgcccctattttgattctcattttcaaacaagtacatggtttcgccgcaaatggcaagaaaaaagtccactactacaatgagatcagtgtttccatcgcttgtggcatcctgctagctgccctgcaggtaaataatggaatcaccatgcggcatcagactgcgaggcaccgccacctgattgagggtcctggaagaagcagcgaagcctgcagcaagctcagctcacaaggctgcccaggtgcctctgcagcaggcagtctttttcactttgccattgagtttgctgccccctagctttcataaggcataatcccgagagtaggttatgattagtgatggaggaaagaaaaatctccatgaagcccgcatctccagtatggtgactgggtctgataagcgcgccatgcatgtcttgtagaggcagcttccagaacttcctggtcaggtttagaggtggtgatctgattggaaaagctggagaggggcaggcggggaagtgtctggaagctactcattgcttttacttagatgtttgttatttggaggcttggaaagaggtcgatggggtaccccttggccactgagtcccctatcaacgggcatcagcatctcactgggtggggatgctctgcttccatggttggctctgtagtcataggaacttgccgtggtggttgttgtttagaatataatatacaagcctttattaatatattaaataccaagagctagtcgtagctctataattttaaagtagtgatgaatgtaatgatattttaaaatatctataacaactgtaaaatgatatgaaaataactgtggatttcattggtgataaagtcatagatattgctaacactactgtggtttgctgcctacatttataaaggaagaaactgctaaatttcagttagatgttagtgaatatgaaaactttttttttcaaattcaagttcatggacctgctaaattcaatccttggccctttgggggtctgaggattccagttaaaaaaatcctgacctataataagaccaaagtactcacatcgagagagtgaaagataaaataataatagaagtcaacttaacattaataatattaataagaggaattgtttaatatggtctgtgtatttgcaggtttctactgctagagacatacaaaattcagtatggagtaaaagctatgtcttgaaaaggaccaagatataaaatgacactaaattaaggtgtaaatattttctcaaaaaagtttaagacttggccaggtgcggtggctcacgcctctaatcccagcactttgggaggccaaggcgggcggatcacgaggtcaggagatcgagaccatcctggctaacatggtgaaacccggcctttactaaaaatacaaaaaatgagccaggcgtggtggcgggcgcctgtagtcccagctactcgggaggctgaggcaggagaatggcgtgaacctgggaggcggagcttgcagtgagcggagatcccgccactgcactccagcctgggcgacagagcgagactccgtctcaaaaaaaaaaaaaaaaa

SEQ ID NO: 144367 - DNA, 5279 bp, Homo sapiens
  Payload ID: 8523
  Gene Symbol: IQSEC1
  Gene Name: IQ motif and Sec7 domain 1
  Uniprot ID: Q6DN90
  ENST ID: ENST00000273221
  CDS Start-End: 218-3109
gcgggcttggctggcctggggctcggacttggggccggagccgcgggagccggcggacgctggaccaggagccccgacgtgatcgcgtggcgggtggtcgggtctccgggtggccgggtgtcggccccgggatccggcggctcgctggcgggagtcggcggcctctgctgggcctgggtcccggctcccggcccggcccgctcccactgcggccgccatgtggtgcctgcactgcaactcggagaggacccagtcccttctggagctagagcttgacagcggcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaatttcagcctttcgagccactgcagccgtcagtgctgtgctcctaagccatgggacccgaggactgccccccggcgcctgcccaggcggaggccctttcagaaagggcgaagctcacgcctgactctgcgggccgcggggccgcgttcccagtggacagcgtggtgagccgtggccggacggcaggaggagaggggagccccctctggctgtgtgtcaccttggctggctggctggccagggttttgccgatttccctcctcacatccctcccaccctcggtcatatcattgagatcaccgtaccagcaaatctgcaaaccaagcactttgttaatctccagagagagcaaatacagcaatctagagtttagcctttttaaaaatgtgactttaacccgcccacctgtgtcctcccattggcgtggcatttctttggtgtctgctcagaaagaaacagcatgggaccgtgtgattgggtccaggctgggctgtcagggaagcgccctggtgtctccgactcatcaattctcgggtcttttttaaaagccaggctccccaaagcactctgtctcgcaattttgaggaggctgttccgacctggaagcgttaaactgctgcatgtcatctggcgtcagctgtgaggctgcgctctgcgtgttgtgcgtttgcaaaatgtattggcgtgactgtaaacacatcgttgaagtaaagcgattacatattgagtatgtcagcttttctcaccctcttctgtgctgggaggagagtctaactgtaacctttaggttgttccagaaaagattcaggccgtttggcacagaattgctctttctgaagggtagcagtaatgaataggaacagacagaaaaccccaggaggggctttcaggaaactctccctctccatcgccatcctgcaagctccacagcctcgggctgccagcctgtggcactgtcctcggtgtgtcctggagctgtgctgggcagcagggcctcgcgtaaggaactgctggaacccactgagcccttcccggggtttcccgccgcactcagtgtgttccttcaggctagtgaggtttcattctgttttatttgcaagcttatcaaaagtttgtggaagatacattgttgggttccagaggctggagtcatgctgcccacatcttgtttgggaaagcaaaagctcccagtgagctggtgtccccgtgtgtctttcatgggactgtcccctttagagatcccacctgtcagagccacagcttcggggtcctgtcatcacatcccctgggaggggaggcaggaggaggccgagggccccaggatgtctgcctggtcccttctcactgtgaggacgcccttggcacacctttctcaagtcacacaaattactgcagttacatacagaattgctgacaggagcaggagacgctgagggaaacagctggcaatgtgacaaaagtcttttctgggacaacaatcaaatcatgtatttgtatttttttaagtttaccaatgaattgtacaacaatgtaaaaataaagttcatcctaatatgctgtgcacatcttgcttaaaaatgtcttcagcacccagtgcagtgatctttccctcacacactgcatgcagcaggagcctcttgtttttcttaatgagctgaaaagacagcagatgttcacagctgatgctgggtgttgactcagcgccacgggaagctctgtgcccgcaggtaagcacgcacagtcttacagttctccttgtaaaatatcatcacccttcctgcctgagaaacgagtacatttgtattttatgtaacaacaatagtcaaggcagcattgcaacactgagcagggtgaggtgggggtgctgagcacaggacaagagggaggaggcctgccctccattcagatgcatctgcatcgcccttctgtgtgcagtcacatcgagactgcacacagcatgcatctcctcttggaaaatatcttttgcctccgagttgttttaagcaattagaatcaggtcctgaatccccagactgttcagagacttcaagggacacctccctcacaagaagcctggcacccccactgtgtacctttgagaggaaaggagtgcgtttgttttcatctgcattctgtttgtcagtggcaacagactctatcaatgtaaaaccatggttgtgatcatgtggggaaatcaaataaatcctttgaaactct

SEQ ID NO: 144368 - DNA, 3744 bp, Homo sapiens
  Payload ID: 8523
  Gene Symbol: IQSEC1
  Gene Name: IQ motif and Sec7 domain 1
  ENST ID: ENST00000618604
  CDS Start-End: 368-2812
cctgagaagccagccaggctgcggctgtttgtggcaggaggcccccacccacagcactggaccaagcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccggggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctgccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaaccggagccccaggagcccacagggctggtgttgtgtggaacaaaggcccagatttcatttcttgttggcaccctgggctctgctcacctcagtctgagggatgggtgggcctcagacaccatcagccttgaaacggtgagccagccaagtagtgttgaactgcctcccccactccagctctcagctccctgtgccctaatgtacatgcatatgaaaacccaacctagaaaacgaagaaatgagatacaaaaacagacaaaacaaaccccaaaa

SEQ ID NO: 144369 - DNA, 3582 bp, Homo sapiens
  Payload ID: 8523
  Gene Symbol: IQSEC1
  Gene Name: IQ motif and Sec7 domain 1
  ENST ID: ENST00000613206
  CDS Start-End: 104-3448
attcccctccacttcttgcctgagccgcctgctcctcttggaaacacgttgagcctccccgctggagagggagccagaacagggaagaacggattcacacaggatggcttgcagaagacgctatttcgtcgagggcgaggcccccagcagtgagactggcacatccctggacagcccctcagcctacccccagggccccttggtgcccggttccagcctgagcccggatcactacgagcacacgtcagtgggagcctatgggctgtactcggggccgccggggcaacagcagcgcacgcggaggcccaagctgcagcactcgacctccatcctgcgcaagcaggctgaggaggaggccatcaagcgctcacgctcactctccgagagctatgagctctcctcggacctgcaggacaagcaggtggagatgctagaacgaaagtatggggggcgcctggtaacccgccatgcggcccgcaccatccagacggcgtttcgccagtaccagatgaacaagaacttcgagcgcttgcgcagctccatgtcagagaaccgcatgtcacgccggattgtgctgtccaacatgaggatgcagttctcctttgaggggcctgagaaagtgcacagctcctacttcgaggggaagcaggtctcagtgactaacgacggctcccagctgggagccctggtgtcccctgagtgtggtgacctcagcgagcccaccaccctcaagtctccggccccctccagtgactttgcggacgccatcaccgagctggaggacgccttctctaggcaagtgaaatcactggccgagtccatcgacgatgccctcaactgccgcagcctgcacactgaggaggcaccggccctggatgcggcgcgggcccgggacaccgaaccccagacagccctgcacggcatggaccaccgcaaactggacgagatgacggcctcgtacagtgatgtcaccctgtacatcgatgaggaggagctgtcgccccctctgcccctctcgcaggcaggggaccggccgtccagcaccgagtcggacctgcggctacgggctgggggcgcagccccagactactgggccctggcccacaaagaggacaaggctgacacggacacgagctgccggagcacgccgtcgctggagcggcaggagcagcggctgcgggtggagcatctgccgctgctcaccatcgagccacccagcgacagctctgtggaccttagtgaccgctcggagcgggggtcactcaagaggcagagtgcttacgagcgcagccttggcgggcagcagggcagtcccaagcatggtccccacagcggcgcccccaagagcctcccccgggaggagcctgagttgcggccccggccccccaggcccctggacagccacttggccatcaatggctcagccaaccggcagagcaagtctgagtcggactactcagacggtgacaatgacagcatcaacagcacgtccaactccaacgataccatcaactgcagctccgagtcatcgtcccgtgacagcctgcgggagcagacgctcagcaagcagacctaccacaaggaggcccgcaacagctgggactcgcctgcctttagcaacgatgtcatccgcaagaggcactaccgcatcggcctgaacctcttcaacaagaagcctgagaagggagtccagtacctcatcgagcgtggctttgtgcccgacacgcccgtcggggtggcccacttcctgctgcagcgcaagggcctcagccggcagatgatcggcgagttcctgggcaaccggcagaagcagttcaaccgtgacgtgctcgactgcgtcgtggacgagatggacttctctaccatggagctggatgaggccctcaggaaattccaggcgcacatccgtgtccaaggggaggctcagaaagtggagcggctcatagaggcgttcagccagcgctactgcatctgcaaccctggggtggtgcggcaattccggaacccagacaccattttcatcctggccttcgccatcatcctgctgaacaccgacatgtacagccccaatgtcaagcccgagcggaaaatgaagctagaggacttcatcaagaacctccgaggtgtggacgatggtgaggacattccccgtgagatgctgatggggatctatgaacggatccgtaagcgagagctaaagaccaatgaggaccatgtgtcccaggtgcagaaggtggagaagctcattgtggggaaaaagccgatcggatccctgcatcccgggctcggctgtgtgctctctctgccccaccgtcggttggtctgctactgccggctctttgaggttccagacccaaacaagccccagaaactcggactacaccagcgagaaatcttcctgttcaacgacctcctggtggtcaccaagatcttccagaagaagaagaactcggtgacgtacagcttccgacagtccttctccttgtacggcatgcaggtcctgctcttcgagaaccagtactaccccaatggcatccggctcacctcgtctgtccccggagcagatatcaaagtgttaataaacttcaacgcccccaaccctcaagaccggaagaaattcaccgatgacctgcgggagtccattgcggaagtccaagagatggagaagcacaggatagagtcggagctcgagaagcagaaaggcgtcgtgcggcccagcatgtcccagtgctctagcctcaaaaaggagtcgggcaacggaacactgagccgggcctgcctggacgacagctatgccagcggtgagggcctcaagcgcagcgccctcagcagctccctgcgggacctctcggaagccgggaagcgagggcgtcgcagcagtgcgggatcgctagagagcaatgtggaagggtccatcattagcagtcctcacatgcgccggagagctacatcaacacgagagtgtccatctcgcccacaccagactatgcccaactcatcttccctcctgggctccttattcgggagcaagagagggaagccccctccccaggcccacctgccctcagccccagccctgccacccccccacccaccggtggtcctgcctcacttgcagcactctgtggctggccaccacctggggcccccagaggggctgccgcaggccgccatgcacgggcatcacacccagtactgccacatgcagaaccctcccccgtaccaccatcaccaccaccaccacccaccccagcacatccagcacgcacaccagtaccaccacggcccccatgggggccacccagcctacggggcccatgcccacggccacccgccgctgccctcggcccacgtggggcacacagtgcaccaccatgggcagccccctgccccgccgccccccaccagcagcaaggccaaacccagcggcatcagcacaattgtgtagacagcctgggtaggggtcccaggctccctgaaacacctgcacaccacacagggcacgcccgggggtcgccagccgcacaccaaacccggggcacttctgttgccatctctcccctctgcccctcacggcccaac

SEQ ID NO: 144370 - DNA, 4004 bp, Homo sapiens
  Payload ID: 8524
  Gene Symbol: IQSEC2
  Gene Name: IQ motif and Sec7 domain 2
  Uniprot ID: Q5JU85
  ENST ID: ENST00000375365
  CDS Start-End: 94-2943
tccttctagggaagggctggggaggagggggtggtgacacggtggagacaccggctaggccagggggcctgcccttgggacaggtccagacccatggagccccccgggaggagcagcaggtccacagcgtctcatactctacaccagtattgctgtcctactcaggtccttgactccatgaagcttaccccctcaggcaggctggcagagagcagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcaggggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagc

SEQ ID NO: 144371 - DNA, 6011 bp, Homo sapiens
  Payload ID: 8524
  Gene Symbol: IQSEC2
  Gene Name: IQ motif and Sec7 domain 2
  Uniprot ID: Q5JU85
  ENST ID: ENST00000396435
  CDS Start-End: 202-4668
cggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaaatctgatggtgagaattccagaacagtcagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggactgtgtggtggatgagatggacttctcctccatggatctggatgatgcgctccggaagttccagtcccatatccgggttcagggtgaggcccagaaagtggagcgactcatcgaagccttcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtcctgtctctccctcaccgtcgactggtttgctgctgccagctctacgaggtgccagatccaaaccgcccccagaggctagggttgcatcagcgggaggtcttcctcttcaatgatctccttgtggtcaccaaaattttccagaagaagaagatcttggtgacgtacagtttccgtcagtctttccccctcgtggaaatgcacatgcagctcttccagaattcatattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcagggaagcgggggcggcgtaacagcgtgggatcgctggacagcaccatcgaagggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctca

SEQ ID NO: 144372 - DNA, 2701 bp, Homo sapiens
  Payload ID: 8525
  Gene Symbol: IQSEC3
  Gene Name: IQ motif and Sec7 domain 3
  Uniprot ID: Q9UPP2
  ENST ID: ENST00000382841
  CDS Start-End: 413-2692
aagcccctccccttctctgggccttgatttcccctcctgctcagtggggacgttcttggtcctccttcttgcccactctacccagtcgccgagtctggcgaagcagagctgtctgggggtcaccgcagcaggagggaccgagcttagatacgaaaaaagacttctacacggcaagagccacagaaaggacgctccagctggctcagcagaggggcatctctccctttcaagaacaaaaggtggcaggtacccgggggccctggggcagaacgaggtaaattctgcacggacttccacatctaagaccccagaaatctccagccggctccctccgaccgaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggtaa

SEQ ID NO: 144373 - DNA, 7094 bp, Homo sapiens
  Payload ID: 8525
  Gene Symbol: IQSEC3
  Gene Name: IQ motif and Sec7 domain 3
  Uniprot ID: Q9UPP2
  ENST ID: ENST00000538872
  CDS Start-End: 119-3667
ggaggctgggccggtgggagagggaggcgagccgaccgctgggctgctgggctcccgcgccctcgcgctccccgccgccagcccaggcgcaggcagggcgcaggcggcggcgggcggcatggagagcctgctggagaatccggtgcgcgccgtgctctacctcaaggagctcacggccatcgtgcagaaccagcagagcctcatccacacccagcgagagcgtatcgacgagctggagcggcggctggacgagctgagcgctgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagaatgagaccgtgctgcaccagttctgctgcccagccgccgacgcctgctccgacctggcctcccaaagtgatggctcctgcacccaggccggtgggggcatggaggactccgtggtggcagcggcggcggtggcagccggcagacccagtgcccatgccccgaaggctcaagcccaggagctgcaggaggaggaggagcggccgggggcaggggctgcctccccaagggctggcccccagcacaaggcctcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccacgggatcgcgaggtcatgtatctgcaaaatgcacctttttaaagagtgtcttagttccccagccccagctaatacccggccaatgccgtgtacgcaccggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggagtgcgaggtatgggggaataggaactatgagctaaatatacttatggggtgggggccgtgggggccagggacactctcccagacagccctgacccgccaggcaggaccccgtcccctgctcacacagctcttcaaacttaccaaggacaggcaggaccccgtcccctgctcacacagctcttcaagcttaccaaggacaggcagaaccccgtcccctgctcacacagctcttcaagcttaccaaggacaggcaggaccccgtcccctgctcacacagctcttcaaacttaccaagtgccctctcccctgttgagggcacagcaaccccaggccctccctcccacctcagctgaagccccaatcttccaaatcggaaccagcaagtcttagggctggcacgcatctgggcctctagctgagaacccggactctcaggcacctcagtgcccctgccccagggcagaggcccaccccgtgggttggtgcagtggctgccctgggctccacgggcagcacagggagtctgtccaggaagcagcccagccggggtcagtattccgtggagccagtcctgagctgggaggggcatttaacacccctgagggcctggggcaggacacagctggccctcctcattgtcaggggaagcaagtgcccaacatctgtaacctcccttccctgctcagtccccaggccaaggttgggacccctctccatccctgtccccagagcctagacctcagggacctaggaaaagcctcctgctccctccccacggcagcagacagggcagggcctccagcccccagagggccggtggggggtgctctcgggccttcctgctctcctaaggttgcggggacagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgagcaaa

SEQ ID NO: 144374 - DNA, 2701 bp, Homo sapiens; identical to SEQ ID NO: 144372
  Payload ID: 8525
  Gene Symbol: IQSEC3
  Gene Name: IQ motif and Sec7 domain 3
  Uniprot ID: Q9UPP2
  ENST ID: ENST00000571363
  CDS Start-End: 413-2692

SEQ ID NO: 144375 - DNA, 3232 bp, Homo sapiens
  Payload ID: 8525
  Gene Symbol: IQSEC3
  Gene Name: IQ motif and Sec7 domain 3
  ENST ID: ENST00000575724
  CDS Start-End: 119-3232
ggaggctgggccggtgggagagggaggcgagccgaccgctgggctgctgggctcccgcgccctcgcgctccccgccgccagcccaggcgcaggcagggcgcaggcggcggcgggcggcatggagagcctgctggagaatccggtgcgcgccgtgctctacctcaaggagctcacggccatcgtgcagaaccagcagagcctcatccacacccagcgagagcgtatcgacgagctggagcggcggctggacgagctgagcgctgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagaatgagaccgtgctgcaccagttctgctgcccagccgccgacgcctgctccgacctggcctcccaaagtgatggctcctgcacccaggccggtgggggcatggaggactccgtggtggcagcggcggcggtggcagccggcagacccagtgcccatgccccgaaggctcaagcccaggagctgcaggaggaggaggagcggccgggggcaggggctgcctccccaagggctggcccccagcacaaggcctcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggag

SEQ ID NO: 144376 - DNA, 2891 bp, Homo sapiens
  Payload ID: 8526
  Gene Symbol: IQUB
  Gene Name: IQ motif and ubiquitin domain containing
  Uniprot ID: Q8NA54
  ENST ID: ENST00000324698
  CDS Start-End: 178-2553
ccacccgcctctggctcctctccttcccacccctgccgtgctccggcaggaagaggtggtgccagggccgttgctaggatacgaccaacagctgagaacgcggcgagtatggaagctgcgtcttaggagcctgggaaagcacttcgacgagaatagtttggtttcgtacacaggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatttcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgatagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccaatcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatggaatttaatctgtttattgattttgttttttgtttttcatagtattttgagttatataaagagaaaacatttctatataagtaagtattctttgttaggaagttggtgctaaattgaaatgcaattttgttactgaaattaatattttggggtaaagaaaacattttaaaatgtgttttcacattaaattttttaaattttttcaagtatattagagttaaaatctaacaaacagccaaataaaaactagacaact

SEQ ID NO: 144377 - DNA, 3024 bp, Homo sapiens
  Payload ID: 8526
  Gene Symbol: IQUB
  Gene Name: IQ motif and ubiquitin domain containing
  Uniprot ID: Q8NA54
  ENST ID: ENST00000484508
  CDS Start-End: 165-1955
gagcaactgccggcctccgcccccagccgcagccggtcactggcggcgccttccgcgccaagcttgggggccttttcggggtcctacatggcacggcttccgacccccggcccgggacggggctcgcaggccccagaggggcaggctggagaaggaggaggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatttcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgatagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccaatcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaagatgggtggagaatatctttccatggcattatagtaaatgctccatctataatggagacgtgtgctaacgtgttttcatgaggttgactgatatatttgctaatttaatgcctaggaggcatgaagataaaataatcattcaagataaacaaaatgtgtaaatctcagaataagaaaaggaaccagtatttatttaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatggaatttaatctgtttattgattttgttttttgtttttcatagtattttgagttatataaagagaaaacatttctatataagtaagtattctttgttaggaagttggtgctaaattgaaatgcaattttgttactgaaattaatattttggggtaaagaaaacattttaaaatgtgttttcacattaaattttttaaattttttcaa

SEQ ID NO: 144378 - DNA, 2321 bp, Homo sapiens
  Payload ID: 8526
  Gene Symbol: IQUB
  Gene Name: IQ motif and ubiquitin domain containing
  ENST ID: ENST00000469057
  CDS Start-End: 77-1342
ggcgagtatggaagctgcgtcttaggagcctgggaaagcacttcgacgagaatagtttggtttcgtacacaggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatttcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgatagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgc

SEQ ID NO: 144379 - DNA, 3296 bp, Homo sapiens
  Payload ID: 8526
  Gene Symbol: IQUB
  Gene Name: IQ motif and ubiquitin domain containing
  Uniprot ID: Q8NA54
  ENST ID: ENST00000466202
  CDS Start-End: 578-2953
gagcaactgccggcctccgcccccagccgcagccggtcactggcggcgccttccgcgccaagcttgggggccttttcggggtcctacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggtctgtgtattgttctcagtggtcccaagaattactcgaatatagttgtttttctgagggaggatggatggagataactatcctgatcccagtgtcactttttaaggcattcgcttcaagagacaagcagtttagaatcaggcagaactggattgcaaaatttatgggcagaccggaaaatgtctaatcaacaggagaagtatgaagctcagaatatagtcaattcaacagaagagagtgatgatgcttttgatactgtcactattccagttccctcagaagagcctcaagagtcagatcaaactgaagagcatgaatctggaatagaacaattcagtgagagccatgcaatacatgttgaggagcagagtgaccaaagcttttcaagcctggaaccagacaatgaacaactcatggaagaggttatatcaccaagacaagtttcatatactccgcaacatcatgaaaagcaatatgcaatgcagaggccaaatgatgatagtttggcatttctggataaaataaagtctgtaaaggaatctttgcaagaatcagtggaagattctctagcaacagtaaaagttgtacttattccagtgggccaggaaattgtaataccttttaaggttgataccattcttaaatatcttaaggaccatttttcacacttattaggtatcccacattctgtactgcagataagatactcaggaaaaattcttaaaaataatgagactctagtacaacatggagttaagccacaggaaattgtacaagtggaaatcttttctacaaatccagatctgtatccagtcagaagaatagatggattaactgatgtctctcaaatcataactgtcactgtccaaactggacttgatcaataccagcaggtacctgttgagattgtcaaatctgactttcacaaaccatttcttggtggattcagacataaagtaacaggagtagagtatcacaatgctggaacacaaactgtacctaaaaggattcccgaaagactcagtatattttgtagggatacgcagacagtttttcagaaaaaaaatctccaacaaactacaaatacaacatccacacagatgactaacattggtgtatatgtatcaaatatgactgataaactggtaacaccaggaaagtatttttcagcagcagaataccatgctcaaagactaaaggcggtgatagtgatacagacttactacaggcaatggcatgctaaaatcttcgtagagaatttaagaagacagaaaagcttaagactggaatgggaaacacagcaagaactaaggaagataagagaaaaagaagaatggataaaattggactatcaccggaggcataatcctaaaacaaatgaagattttgaatttctttataatgcattagaattctggcggcaagaagaacttacacgtattaaccaatcttttactggagctgaaaggaaagctgctctgtgtgaacttctggaaaaagagactcagataattgcttccattgggagacatagatacattgcttatatggcaaatcaggaagcagcaatacaagcttttttggataagtgttcagctccaaaaatatggagaacccctaatggcaaaacaattgagatggatacgcagttcaccatcagagccagagagctgcaaaatatctataagtgcattatgctgaaaaatatctcccaagatgagaggctggatgtgctgttaactcttaaacacactgtaaaggaacatgaatgtaaactaactcaggaaattctagaattgattgacagagaggttgaccttatgatgagaggagtcaaacatcataaccttgaaggactcagaaaaagaattgcgacactcttttttcattatatcaaaacacctctgtttaatcctgaagttgcaaaataccttaaggtccctcaagacccattgaaattttataagaagatttacttttgccacagttgccagctttatttgccttctacagaattttctgtatcatccacctcacgccgcatataccggtgtcgtaactgcattaaccttcagaatgaggctcaaaaacgagaatcatttttgaagtacaaatgtttacttcaacagctctactatacagaagctgattatgaagatgattctaaaattgctttcttgatgcagctacaagacattcagtacctgacagagaacatctgggcgtcccagtcagtcctcagtgcttgcgacaatctcagtgatctggtcatggtcagatggaataaatccctggagtggtccccctggaactgcattcttcttaccaaagatgaagcagctgctcatctcaagctaacaagtattgaagagggatatgaacgctcatttattcacaagatcaaacacaaacatatcctggctaagaactatttttctcaggttccagtgctggcttcatttatacttgatgatggtgaaattgatgagatcagatggaagtatcactcagacacaacacctaagattatagaatcccagaggcctcctcattaggtgatccaggagtatttgtttgatgatcggcattttgttcactgctaatagggtaatacagaggtcacagagtatggaaatggaatttaatctgtttattgattttgttttttgtttttcatagtattttgagttatataaagagaaaacatttctatataagtaagtattctttgttaggaagttggtgctaaattgaaatgcaattttgttactgaaattaatattttggggtaaagaaaacattttaaaatgtgttttcacattaaattttttaaattttttcaagtatattagagttaaaatctaacaaacagccaaataaaaactagacaactttcaa

SEQ ID NO: 144380 - DNA, 2594 bp, Homo sapiens
  Payload ID: 8527
  Gene Symbol: IQCB1
  Gene Name: IQ motif containing B1
  Uniprot ID: Q15051
  ENST ID: ENST00000310864
  CDS Start-End: 216-2012
cgcctccaggccccttcccgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatactacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatcgttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 144381 - DNA, 1919 bp, Homo sapiens
  Payload ID: 8527
  Gene Symbol: IQCB1
  Gene Name: IQ motif containing B1
  Uniprot ID: Q15051
  ENST ID: ENST00000349820
  CDS Start-End: 171-1568
ggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatactacagatcaacagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatcgttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaa

SEQ ID NO: 144382 - DNA, 2253 bp, Homo sapiens
  Payload ID: 8527
  Gene Symbol: IQCB1
  Gene Name: IQ motif containing B1
  Uniprot ID: Q15051
  ENST ID: ENST00000393650
  CDS Start-End: 216-1127
cgcctccaggccccttcccgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatactacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatcgttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaa

SEQ ID NO: 144383 - DNA, 701 bp, Homo sapiens
  Payload ID: 8527
  Gene Symbol: IQCB1
  Gene Name: IQ motif containing B1
  ENST ID: ENST00000498104
  CDS Start-End: 448-701
cggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagccattgctgtgtgggcttggagccaggagaagatgcagaggaattttacaatgaattacttccatcagctgcagaaaattttctagttttggggagacaattacaaacatgttttatcaatgcagctaagtactacaaagtgatcatttcttacatttactgcaagctgacaatgtccaaataggatctgcagtcatgatgatgctacagaatatactacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactga

SEQ ID NO: 144384 - DNA, 988 bp, Homo sapiens
  Payload ID: 8527
  Gene Symbol: IQCB1
  Gene Name: IQ motif containing B1
  ENST ID: ENST00000460108
  CDS Start-End: 559-988
gccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatactacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtt

SEQ ID NO: 144385 - DNA, 602 bp, Homo sapiens
  Payload ID: 8527
  Gene Symbol: IQCB1
  Gene Name: IQ motif containing B1
  ENST ID: ENST00000462442
  CDS Start-End: 340-602
cgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtagtagccttaaaatagataaataattgtctttttgtgtcaaatttcatgaatttaatgtaaagatgggagaagtgttgaattataggagaaacactcgagaaagtttacagatggtttccataacaggtggtttttcagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaag

SEQ ID NO: 144386 - DNA, 2027 bp, Homo sapiens
  Payload ID: 8528
  Gene Symbol: IQCC
  Gene Name: IQ motif containing C
  Uniprot ID: Q4KMZ1
  ENST ID: ENST00000291358
  CDS Start-End: 22-1422
cgggcctggcagttggcgcccatggagccagagctgctggttcggaaggtgtctgcattgcaggcctgcgtccggggcttcttggtccgacgccagttccagagcctgcgagctgagtatgaggcgattgtacgagaggtcgagggcgacctgggcacgcttcagtggaccgagggccgcattcccaggccgcgattcctcccagagaaggcaaaatcccatcagacctggaaagcaggagacagggtagcaaatccagagcaggggctgtggaaccacttcccatgtgaagagtctgagggagaggccacctgggaggagatggtgctgaagaagtcaggagagagctcagcaaatcaaggaagcctctgcagagatcacagctcctggcttcagatgaagcagaacaggaaacccagccaagagaagaccagagacacgacaaggatggagaatccagaagccacagatcaaagactgccccacagccaacctcagcttcaagagcttcagtaccaccgcagccacttggccatggaattgctgtggctgcaacaggccatcaatagccgtaaggagtacctacttcttaaacaaacactgagatccccagaggcgggcccgatcagagaggaaccccgcgtgttcctagaacatggggaacaggcctgtgagagggaccagtcacaaccaagcgcaccactggaggaccagtcctacagagacaggaccactggagagctagaacaggaggatgactcctgtcacagggtcaaatcaccccacagatccccaggaagtttggccactacacaaaaaaacattgctggggctaagtgcagagaaccatgctacagcaagtctggaccaccgtcgtctataccatcaaacagccaggccttgggggacaggctcaccaaagggccagacgatggaagacagacctttggagggacctgcctgctgcagatgaaaatcctggaggaccagacccccagaggtttaaaacctaggaaccattgtcccaggaagtccaggacacagctgtctgcactctatgaggactcaaatattaaggagatgtctcccagaaaactagaccacaaagagcctgactgccgaacagtcaggacacaagagttgggcctctcagaggaccacatcatctgggatggtaccttgggggggccagagcatagtgtcctcgatctctggaggactaaaccacccaaaggccaggcccccactgatagaagctccagagatggaacctccaatgagcctagtcatgaaggacagaaaaagcagaggactataccatggagatcaaagtcacctgagattctgtcttctacaaaggcaggctgtacaggagaggaacagtggaggggcaggccatggaaaacagaaccacctggctagaccctaggaagccaggagaggatcaggttccaaaggggaatgctatgaaagggcagtgagacaagacctcatcctacctccctgaccagctctggcttctgctcctgcccctggccattggtgactagtggggccaagagaagctggagcagagagctggcatgagtatagggaaggaggaaggacacattttcaatcctctgcctgtagctcaatccaaatttgtggataaggggccgggtgcagtggctcacacctgtaatcccagcactttgggaggccaaggtgagtggatcacctgaggtcagaagtttgagaccagcctgaccaacatggtgaaatgaaaccccatctcaactaaaaatataaaaattagccaggcgtggtggtgcatgcctgtagtcccagttactcgggaggctgagacaggagaatcgcttgaacccaggagatggagattgcagtaggccaagatgatgccactgcactccagcctgggctacagagcgagacacggtctcaaaaaacaaatgtgtggctaaggagttacctgggggaagtagaatgagaggtctgttgggaataaaggtttttcttagattctg

SEQ ID NO: 144387 - DNA, 2252 bp, Homo sapiens
  Payload ID: 8528
  Gene Symbol: IQCC
  Gene Name: IQ motif containing C
  Uniprot ID: Q4KMZ1
  ENST ID: ENST00000537469
  CDS Start-End: 12-1652
agttggcgcccatggagccagagctgctggttcggaaggtgtctgcattgcaggtgcgggggcgggcgcggggttcacaggatttttcctttagggaaatcatggggtctcgtacctggacctcccagcgagatgctaccacgttcagtcccctaactgcgcgccaacctctggagataccggctgtccccaaccgcgctgaggaaagctgggacccacggactccctgccctgcgcgtccccactcccaccacacgctcgcgccggatcagggaaacgggaagagccttaaggcctgcgtccggggcttcttggtccgacgccagttccagagcctgcgagctgagtatgaggcgattgtacgagaggtcgagggcgacctgggcacgcttcagtggaccgagggccgcattcccaggccgcgattcctcccagagaaggcaaaatcccatcagacctggaaagcaggagacagggtagcaaatccagagcaggggctgtggaaccacttcccatgtgaagagtctgagggagaggccacctgggaggagatggtgctgaagaagtcaggagagagctcagcaaatcaaggaagcctctgcagagatcacagctcctggcttcagatgaagcagaacaggaaacccagccaagagaagaccagagacacgacaaggatggagaatccagaagccacagatcaaagactgccccacagccaacctcagcttcaagagcttcagtaccaccgcagccacttggccatggaattgctgtggctgcaacaggccatcaatagccgtaaggagtacctacttcttaaacaaacactgagatccccagaggcgggcccgatcagagaggaaccccgcgtgttcctagaacatggggaacaggcctgtgagagggaccagtcacaaccaagcgcaccactggaggaccagtcctacagagacaggaccactggagagctagaacaggaggatgactcctgtcacagggtcaaatcaccccacagatccccaggaagtttggccactacacaaaaaaacattgctggggctaagtgcagagaaccatgctacagcaagtctggaccaccgtcgtctataccatcaaacagccaggccttgggggacaggctcaccaaagggccagacgatggaagacagacctttggagggacctgcctgctgcagatgaaaatcctggaggaccagacccccagaggtttaaaacctaggaaccattgtcccaggaagtccaggacacagctgtctgcactctatgaggactcaaatattaaggagatgtctcccagaaaactagaccacaaagagcctgactgccgaacagtcaggacacaagagttgggcctctcagaggaccacatcatctgggatggtaccttgggggggccagagcatagtgtcctcgatctctggaggactaaaccacccaaaggccaggcccccactgatagaagctccagagatggaacctccaatgagcctagtcatgaaggacagaaaaagcagaggactataccatggagatcaaagtcacctgagattctgtcttctacaaaggcaggctgtacaggagaggaacagtggaggggcaggccatggaaaacagaaccacctggctagaccctaggaagccaggagaggatcaggttccaaaggggaatgctatgaaagggcagtgagacaagacctcatcctacctccctgaccagctctggcttctgctcctgcccctggccattggtgactagtggggccaagagaagctggagcagagagctggcatgagtatagggaaggaggaaggacacattttcaatcctctgcctgtagctcaatccaaatttgtggataaggggccgggtgcagtggctcacacctgtaatcccagcactttgggaggccaaggtgagtggatcacctgaggtcagaagtttgagaccagcctgaccaacatggtgaaatgaaaccccatctcaactaaaaatataaaaattagccaggcgtggtggtgcatgcctgtagtcccagttactcgggaggctgagacaggagaatcgcttgaacccaggagatggagattgcagtaggccaagatgatgccactgcactccagcctgggctacagagcgagacacggtctcaaaaaacaaatgtgtggctaaggagttacctgggggaagtagaatgagaggtctgttgggaataaaggtttttcttaga

SEQ ID NO: 144388 - DNA, 1369 bp, Homo sapiens
  Payload ID: 8529
  Gene Symbol: IQCD
  Gene Name: IQ motif containing D
  Uniprot ID: Q96DY2
  ENST ID: ENST00000299732
  CDS Start-End: 192-1235
agacaccgagtctcgccttctgagattggcgggtaacctagcaacgcagggaccgcggcggtaactgtggctagggaaacctggagcggtcagagcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggaggagttggaggatctggacgctgttcacagggaggagaagatctcgctggaggagctcaggcggaggcacaaagtgctggtgggagagtttgcgcagatccgggaagagcgggagatcaactccaagaaaaggatggaggcagagcaggagatggtgcgcatggtacgggcggccacgctcatccaggccctatggaagggctatctggtgcgctccctgctcagatccaagaagaagcggggcaagggcaaagcaaaggacaaggagaagggcaagcagaaaggcaaggagaagggcaagggcaagaaatgagctctccacccagcccgctcctgacccttatcttcccagagaccaggccaggaaggcccgagatggagagcactaaattcacggctttcatgtttttatttaataaattaaaaagtatttgaagccacattgaa

SEQ ID NO: 144389 - DNA, 1673 bp, Homo sapiens
  Payload ID: 8529
  Gene Symbol: IQCD
  Gene Name: IQ motif containing D
  Uniprot ID: Q96DY2
  ENST ID: ENST00000416617
  CDS Start-End: 192-1541
agacaccgagtctcgccttctgagattggcgggtaacctagcaacgcagggaccgcggcggtaactgtggctagggaaacctggagcggtcagagcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggtggaaaaggagaactttgtgatccaagaactgaaaaaccacctgcaccaggtgctcaagttctcagagaacagcctcgttcgcactaagcaggaggctgagaagcagcagaaggccgatttccgggcatcacaggccagggtggccaagatccagcaggagatcctgcagctgcagtcacagttttacaacctggtcatggagaaccgggaggcagagcaggcgctgaggaagaagaaatataaagtggaaacggaaatcgagaactggatccagaaatatgatacagagatgggtgagaagcaggaggagttggaggatctggacgctgttcacagggaggagaagatctcgctggaggagctcaggcggaggcacaaagtgctggtgggagagtttgcgcagatccgggaagagcgggagatcaactccaagaaaaggatggaggcagagcaggagatggtgcgcatggtacgggcggccacgctcatccaggccctatggaagggctatctggtgcgctccctgctcagatccaagaagaagcggggcaagggcaaagcaaaggacaaggagaagggcaagcagaaaggcaaggagaagggcaagggcaagaaatgagctctccacccagcccgctcctgacccttatcttcccagagaccaggccaggaaggcccgagatggagagcactaaattcacggctttcatgtttttatttaataaattaaaaagtatttgaagccacattg

SEQ ID NO: 144390 - DNA, 1872 bp, Homo sapiens
  Payload ID: 8529
  Gene Symbol: IQCD
  Gene Name: IQ motif containing D
  ENST ID: ENST00000546692
  CDS Start-End: 375-1613
tggctagggaaacctggagcggtcagagcagaatgctgtctgtatgcctggctggtccccgcctgacacatgtgcctgagatgcctccacacttggtcttcctgcccttgtggccctaacaccctcacaaagctgaaaactgcttccagtgaaaggttctgtgtaaaagcgacagaggacctaagatgaactcttgatgtcaacagttgtggtttctgcagccacactaaccacacagatgtcagcacagctgcactcacacctacttcttcattttgcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggtggaaaaggagaactttgtgatccaagaactgaaaaaccacctgcaccaggtgctcaagttctcagagaacagcctcgttcgcactaagcaggaggctgagaagcagcagaaggccgatttccgggcatcacaggccagggtggccaagatccagcaggagatcctgcagctgcagtcacagttttacaacctggtcatggagaaccgggaggcagagcaggcgctgaggaaggtgccccgggaagcagcgaggatgggccgagggggcccctggtgggggggatgggtgggactgttccatcactcctggaggtccagcagtgttgggcagggcaggactgcaccagctactcaggaagtggcttggtggaggggaagggcacaggagcagggaaggcccaaatccaagccagtgtctcctgggaggcaggaaggggcagcacacaggcctggggacaggggacaaactgggatcctgtcccagcattgctgcatgccagctttgtgaccttgggcaagttcctcaactcctgagaccccacagggataatacccacatcgtcagaggctgggtgccctgcaaaggaatgaagaagtagcatgtaaagctcaggctaattactcaactcctgcccagctgccgatttcacacctcagaaatgaaaatgctaacattggtcttaatggttgttacatgagaattacatgagatggtagtgagagagctggtgcatagtaagtgttcaataaatatcatttctgaccgg

SEQ ID NO: 144391 - DNA, 2179 bp, Homo sapiens
  Payload ID: 8530
  Gene Symbol: IQCE
  Gene Name: IQ motif containing E
  Uniprot ID: Q6IPM2
  ENST ID: ENST00000325979
  CDS Start-End: 287-2179
cgcagaggccgccgcttccaggaagctctccgggacgccgcgccctcgcctctgggcgcctgcgagtctgcggcccgcaggtgacggagctcacggtaatgtttgactagagtcaccacgctcgtggattttgttttcctatttctgtctttctgaagttcatgtgttgagctcacatgttgctgtccggcacctctgaatccacgtgttggcttttccagagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttag

SEQ ID NO: 144392 - DNA, 2235 bp, Homo sapiens
  Payload ID: 8530
  Gene Symbol: IQCE
  Gene Name: IQ motif containing E
  ENST ID: ENST00000325997
  CDS Start-End: 126-254
agcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctca

SEQ ID NO: 144393 - DNA, 6844 bp, Homo sapiens
  Payload ID: 8530
  Gene Symbol: IQCE
  Gene Name: IQ motif containing E
  Uniprot ID: Q6IPM2
  ENST ID: ENST00000402050
  CDS Start-End: 185-2272
ccagggggaacgcaggtcgcttacccggctgggtaggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgggagatgacagtctgtctgcagtcacctttgactctgatgtggagacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggccgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggtcattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccacctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggcaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaagcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctaggaaagtagacaactcccgggggagacgaagtagagagtgagtccccaagaaagggactcctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcacgtctgttgagctgacactgctgaggctgaagctggccccgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggagatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtgccttga

SEQ ID NO: 144394 - DNA, 2086 bp, Homo sapiens
  Payload ID: 8530
  Gene Symbol: IQCE
  Gene Name: IQ motif containing E
  Uniprot ID: Q6IPM2
  ENST ID: ENST00000404984
  CDS Start-End: 45-1979
cccgagccagcaaccctgaggggcggccgggcagcgccgccaccatgttcctgggcaccggggagccggccttggacacgagtcaccttatctctctaagccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctactt

SEQ ID NO: 144395 - DNA, 2170 bp, Homo sapiens
  Payload ID: 8530
  Gene Symbol: IQCE
  Gene Name: IQ motif containing E
  Uniprot ID: Q6IPM2
  ENST ID: ENST00000438376
  CDS Start-End: 131-2170
atggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttag

SEQ ID NO: 144396 - DNA, 541 bp, Homo sapiens
  Payload ID: 8530
  Gene Symbol: IQCE
  Gene Name: IQ motif containing E
  ENST ID: ENST00000422276
  CDS Start-End: 158-541
aagcgatcctcccaccttagcctcccgagtagctgggactacagggagatgacagtctgtctgcagtcacctttgactctgatgtggagacgagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgc

SEQ ID NO: 144397 - DNA, 899 bp, Homo sapiens
  Payload ID: 8530
  Gene Symbol: IQCE
  Gene Name: IQ motif containing E
  ENST ID: ENST00000415271
  CDS Start-End: 162-899
cccggctgggtaggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgggagatgacagtctgtctgcagtcacctttgactctgatgtggagacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacgtctctttttttttagagacggaatctcgctgtgttgcccaggctggtctcaaattcctggactcaagtgatcctctcaccttggcctcccagaatcctgggattacaggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgg

SEQ ID NO: 144398 - DNA, 866 bp, Homo sapiens
  Payload ID: 8530
  Gene Symbol: IQCE
  Gene Name: IQ motif containing E
  ENST ID: ENST00000423196
  CDS Start-End: 60-866
gctaaagagatctggaaacagctggctgtgtggatgtacccagggcatcttcgtcagggatgttaagatgtgcagacacccaagtgaccatcctaggaagattacactcccaggtccctagaaacaggaggcagggcacgcaaggccacgcaggagcggcgcgtcggccaggaggcggcagggtcgtgcggaagacctgggccagggcctttatcatgagaaggagagggcgaggtgaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctggtaatttcattcatttggattctggcaccagggcagctggtctgctgaggtctcagccaaagagtggccacctccaggaagcccgggctgtgtcggga

SEQ ID NO: 144399 - DNA, 543 bp, Homo sapiens
  Payload ID: 8530
  Gene Symbol: IQCE
  Gene Name: IQ motif containing E
  ENST ID: ENST00000423395
  CDS Start-End: 160-543
agaggccgccgcttccaggaagctctccgggacgccgcgccctcgcctctgggcgcctgcgagtctgcggcccgcaggtgacggagctcacggtagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgc

SEQ ID NO: 144400 - DNA, 580 bp, Homo sapiens
  Payload ID: 8530
  Gene Symbol: IQCE
  Gene Name: IQ motif containing E
  ENST ID: ENST00000427817
  CDS Start-End: 1-580
aagaatataagaatattgtctcctctaagcaagacattcacagaaaaggaggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgca

SEQ ID NO: 144401 - DNA, 2289 bp, Homo sapiens
  Payload ID: 8530
  Gene Symbol: IQCE
  Gene Name: IQ motif containing E
  ENST ID: ENST00000611775
  CDS Start-End: 34-2094
aaccctgaggggcggccgggcagcgccgccaccatgttcctgggcaccggggagccggccttggacacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctggtaatttcattcatttggattctggcaccagggcagctggtctgctgaggtctcagccaaagagtggccacctccaggaagcccgggctgtgtcgggacggaagggaggagtgtcccatctggagctgcctctgaactaagcgtcgccttatgccaggaaggcccacaacagggccccgccttggcccagcttgtcctttgtgcctggaattgccgaggtccttgctgtctttattttttgctctcagctccaacaggaccgaggtggcttcctccttcaggccagcatttctcctgtttgtttgttgagtaaaaccgtgttattgtttcctttt

SEQ ID NO: 144402 - DNA, 2400 bp, Homo sapiens
  Payload ID: 8530
  Gene Symbol: IQCE
  Gene Name: IQ motif containing E
  ENST ID: ENST00000476665
  CDS Start-End: 104-2212
agggaaggccccgaggctgcgggcggccagggctgcccgcggattcccagacccggacgcccgagccagcaaccctgaggggcggccgggcagcgccgccaccatgttcctgggcaccggggagccggccttggacacgggagatgacagtctgtctgcagtcacctttgactctgatgtggagacgaaagcaaaaaggaaagctttccacaaacctccacccacatcgccaaagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctggtaatttcattcatttggattctggcaccagggcagctggtctgctgaggtctcagccaaagagtggccacctccaggaagcccgggctgtgtcgggacggaagggaggagtgtcccatctggagctgcctctgaactaagcgtcgccttatgccaggaaggcccacaacagggccccgccttggcccagcttgtcctttgtgcctggaattgccgaggtccttgctgtctttattttttgctctcagctccaacaggaccgaggtggcttcctccttcaggccagcatttctcctgtttgtttgttgagtaaaaccgtgttattgtt

SEQ ID NO: 144403 - DNA, 6775 bp, Homo sapiens
  Payload ID: 8530
  Gene Symbol: IQCE
  Gene Name: IQ motif containing E
  Uniprot ID: Q6IPM2
  ENST ID: ENST00000623361
  CDS Start-End: 312-2204
ggactctgcgcacgcgcatggtcgccccagggggaacgcaggtcgcttacccggctgggtaggtcggcggcctggttgccatggcagcggggtcgcgggccggcgccagggaaggccccgaggctgcgggcggccagggctgcccgcggattcccagacccggacgcccgagccagcaaccctgaggggcggccgggcagcgccgccaccatgttcctgggcaccggggagccggccttggacacgagtcaccttatctctctaagccgagaaaagtggcctcctggaggtccctcaggacggcagggagcatgcctctgggcggccgagcgtccctgaccccgcagaagctgtggctgggaaccgcaaagccaggaagtctgacccaggccctgaactcacccctcacctgggagcatgcgtggactggcgtccccggcggcactcctgactgtctgacagacaccttcagagtgaagaggccacatctcaggcgctctgccagcaacggtcatgtccctgggactcctgtctacagagaaaaagaagatatgtatgacgagattattgagttaaagaagtcattgcacgtgcagaagagcgacgtggacctgatgagaacgaagctccggcgcctggaggaggaaaacagcaggaaggaccggcagatagagcagctcctggatcccagccgcggcacggattttgttcggactctggcagagaaaaggcccgatgccagttgggtcattaacgggctgaagcagaggatcctgaagctggaacagcagtgcaaggagaaggacggcaccatcagcaaactccagaccgatatgaagactaccaacctggaagagatgcggatcgccatggagacatactacgaggaggtgcatcgtctccagaccctcttggcaagttctgaaaccaccggaaagaagcccctgggggagaagaagacgggcgccaaaaggcagaagaagatgggcagtgccctcctgagcttgtcccggagtgtccaggagctcacggaagagaaccagagcctgaaggaggacctggaccgcgtgctgagcacctccccaaccatctccaagacacagggttatgtggagtggagcaagccccggctgctgaggcgcattgtggagctggagaagaaactaagtgtgatggagagctcaaaatcacacgccgcagagccagtcagatcacacccgccagcctgccttgcatccagctctgcgctgcacagacagccacgaggggaccgcaacaaggaccacgagcgtctccgaggggctgtgagagacctgaaggaagagcggaccgcgctgcaggagcagctgctgcagagagatttggaggtgaagcagctcctgcaggcgaaggccgacctggagaaggagctggagtgcgcgagggagggcgaggaggagaggagagagcgagaggaggttttgagagaggagattcagacacttaccagcaagctccaagaattgcaagaaatgaagaaagaagagaaagaggattgcccggaagttcctcataaggcccaagagctcccagctcccactcccagcagcaggcactgcgagcaagactggccgccggattccagcgaggaggggctcccgcggccccgctccccctgctctgatgggagaagagacgccgcggccagagtcctgcaggcccagtggaaggtgtacaagcacaagaaaaaaaaggctgttctggatgaggcggctgtggtgcttcaggcagctttcaggggacatctcacgcggacaaagctcttagcaagcaaagcacatggctcagagccacccagcgtgccaggcctcccagaccagagctctcctgtgccccgcgttccgagccccatcgcccaggccacgggcagccctgtgcaggaggaggccatcgtcatcatccagtccgctctgcgggcacacctggcccgggccaggcacagtgctaccggtaaaagaaccaccaccgcagcttctaccaggaggagatcggcttcagccacacacggggacgcctcctccccacccttcctcgcagctcttcctgacccctctccctcagggccacaggccttggcacctctacctggggatgacgtcaactccgatgattccgacgatattgtcattgcaccgtctctgcccacgaagaactttccagtttaggtccccgtcactgtctccacgccgtgatggcagcgctgccgaggacataggaaccacgactggaaagataatttatcgtgttaggagaagaacgatgatacctacttaacacctcagcatctgcgtcgtgtctctttgtgcttttgtttgtggaaggagacccaaatgcctttactttattctctggggagggccagcggctcgcatccccctcatctccagctgcagctcggatggtggattttcagtgccaacagacacatctgccgtgaactcgcagatgccagggagccctgtagtgacacgttctctgacagcaccttgccgcctgcccacgaccttgaccgtgaggagctgctatccgcaaccagcgccgacaccatgccccctcttcctggtgacaccctcaacaaccaggatttgctcgatctcagcccagcaggccaggcagacacaccccgctgtgccttaggaaggtgtgagaccggcttcccccatccccacagcaaaacacggcctgtcccaagccagtgaggagctaaagacacccaggtccccaaatgatcttactccatgccccacccgctcacaccgtcctttcccgtcacccttgctatcccctggagcactgccctccagagctgcccttcccaggaaggaatttggttggattctgtcactgtggagaccaagattttttaaaattcccaattacaaaagcagcatcacacttgcttctgagaacagcagggtgatgtctgttcccaagctggtggcgggagccttagcctgtgtggggccacccggggaagaggaggagaggagggtgaggaggcaggctcgccgttccaagggacagcataggctcgtggtggggcgtgttgcatctggtgtctgggacagtccccgtcaccccatgtgtgcggcctctgcactcccaagctccatggctgggctgggctgggctgggctgggctgggccgggcgtgcggagcctgtggagccagcagctgcagaggcctaggagggagttcctgggggaagcgcacagtgtccagtgcccatctcttgcttgtgtgtgagattagcccttgctggggcgtcaagaggaagagccttagacctgggcgggccttcaggggcatctagacccctgcacagcccaggcctggtgtctgcatttccacagcacccctgtggggactcctgccggggctggccgctgtctcaggagagacccaatggttagaaagcccctttttacacagctgacagcttctcccaaggcttccgtccacggggacaggcttaacccctgggcgccttttctgcagcatggcggccttctgagtcacctaagctgagcctgggtcattctctgtggcggtcagaaggccgatggccccaacacagtggcttgtgaaagggagagaggaggctctgcatgtccacctgctctatgggaggaggacacaggtgtccccagcccagcctgttctctcccagtcactcagggatggggccacccaaagtgcaggacccgccccaccctgcggttcgaagcctggcccctgtctccacttagcttctgtttctgcagtgggtggaagcgagtcagcggggggcctggcttgtgtacgtgttttccttatttggtctgtgggttgccaagtccatttttttttccactgaactggctggtaacttgatggactgtgtaactgacacaggccctctttagacccctgccttcaccccacccgcccgggtccactccctggggcgctgtcccaagccatccctgcttgccagctcaaagcttcaggtcctaggagccagtccacctcgaaagccctgagaaagtgagacacctgcacattcgctgggggagaccctccgttctcttgtggcagctgctcccacttgttaaaccaagctgtttctgcgggacgtgctcactcttgggaaccagtggcctagagctttgggttacaggcatggagagggctttcctgcctcaggcttggaggccaatgttccatacataaaccgccatgtcctctggtgcagctgggctgctcttttaaaagccagcatccatcttgaagctcgctgggtaaatggcaatgcattctcaagccagtgtcttcagctgatgcccagtgtccagtgctggtcaccagtcccctttgctgggtacagcctgcctggctgttctgtggtcctggaacgctgcagtgtggttttgttccatggagacagtaccaagcggagaggcctccttgcccacggccccagggcctgggggccaggggttctggccctgcggggacttaggcaggaggggaagagaagcccatggagccatgggaggggtgagctgtgggcggggcctagtcatgggaggggtgagctgtgggcggggcgagctgtgggtggggcctagccatgggagaggtgagctgtgaatggggctagctatgggtggggtgagctgtggacagggcctagccatgggaaaggtgagctgtgggcggggcctagtcacgggagaggtgagctgtgggcggggcctagtcatgggaggggtgagctgtggatggggcctagccatgggaggggtgagctgtgagtggggctgagccatgggagcagcaagctggtggagtgggctgggcggagctgtgggggctgctggcagggcctaggaaagtagacaactcccgggggagacgaagtagagagtgagtccccaagaaagggactcctgccccagcgtcaagtgccaaagcaggccccatctaccacttcagggtcgacgttggtggcaggtgttgttcacggtgtactgattgtcactgcaacacctccacatcaccttgaacttcaagaacagcagcaaagctgtatctgctatcagaggctgttaggtagtccagctttaaaataacacactctttctctatcccatgccctttaaacaagcagccacaggagatgtcagtctccagggcctggccccactgtgttgacagcagtcacgtctgttgagctgacactgctgaggctgaagctggccccgtgcaggtggctggtgagccacaggtgcagtacccggaggtgtgctctcccctagaggcctgtccccaactcctcccctagaggcctattcccgctgctcacagacctcagcagaggcaccagctggagggctccagggacatccttggagatacaggaggctttcctggcacagggcacagctcttaggaggcctttgtaggacgctgtctccccagcgtgtcctgctcatccaggatggggagaaagaggaggaggccccaggctcagaagccagggacagactgccgacgattaccaaactgaatccaggcagtgccatgaccctgggtgtcccttggttcacatcacccaccagacagctgcggagagagtgcagggaggggctgggaccaaacaggccagaaaccagcagaaaagaggcagaagtgaggtgggtgtgcctggggcacgaagccagcgccggggggatttcagtggagccttacagccaggctccgtgcggactgtgatgccagagaggcgtgcagcctctgggcaagtcgggagagggcttgggtggtccccacaaggcagaagaggtggaagggccagagaagaccaccaagaccaccgttcccgcaggcctggggtgagtgacctgactgagactagcgggcagagccaagcagggctaaactccaacccagggcccggtgttggacaaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacctgcagaaagcaccgataaccttcaagatctgaatgagattctattataacccgtctaaacgattgcaaaattcctcctttggttttggaagcagcgtttgctctcccgtggctcggattctctgaggaccagggagttgacacacaaaccccgccatgggtccgagccagctatttctcaaggctcccacctcgccaagctcccaagggcctgctggcagtgcctacgctgtgccaactaccctgtctggtacagaccacggctgggtaagcacccttaaaagcaacagaaatgacgtctggaagctgaaatgtgaaactgtcaagatggcttaggagaggaaggagtggacccgctggtctttggcattttgtatttagaattattctaactttatacataatgtataggccgatcttttggaagggataaggttttcattcttgtgcaactcattattctcattattggccttttaaataaaaagttgttttgcagtgtgccttg

SEQ ID NO: 144404 - DNA, 695 bp, Homo sapiens
  Payload ID: 8531
  Gene Symbol: IQCF1
  Gene Name: IQ motif containing F1
  Uniprot ID: Q8N6M8
  ENST ID: ENST00000310914
  CDS Start-End: 64-681
atggctggatgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagaggctaaaactccagttctggttgagacacagacagtggacaatgccaatgagaaatcagaaaaacccccagaaaaccaaaagaagctctctgacaaagatacggtagccaccaagatccaggcctggtggcggggcaccctggtgcgtcgggcactgttgcacgcagccctcagtgcctgcatcattcagtgctggtggcggctgatactgtccaagattctgaagaagaggcggcaggcagcgctagaggccttctcccggaaggagtgggcagcagtcacactgcagtcccaggcccgcatgtggcgcatccgcagacgctattgccaggtgctcaatgctgttcgcatcatccaggcttactggaggtgccgctcctgtgcttcccgggggttcatcaagggccagtacagagtcacagccaaccagctgcatctccagctggagatcttgctggactcagggccttgcattgtgacagagtgtattcccttctcaataaaggaatgaagtggtcttttcca

SEQ ID NO: 144405 - DNA, 745 bp, Homo sapiens
  Payload ID: 8531
  Gene Symbol: IQCF1
  Gene Name: IQ motif containing F1
  ENST ID: ENST00000314534
  CDS Start-End: 64-192
atggctggatgaacacagatgtgaggggatttgaaccatctacaatcaatccatatgtgaccaatggaggagaagcagccccaaaagacgaaggaaccctcaaaagaagatgagcctcagcagaaggagatgccaacccatttgtccttaggagcagagtcaaaggcagagcaaggcaaggtacttctatagaagggtgcgcccttacagatggagcaatggctaaaactccagttctggttgagacacagacagtggacaatgccaatgagaaatcagaaaaacccccagaaaaccaaaagaagctctctgacaaagatacggtagccaccaagatccaggcctggtggcggggcaccctggtgcgtcgggcactgttgcacgcagccctcagtgcctgcatcattcagtgctggtggcggctgatactgtccaagattctgaagaagaggcggcaggcagcgctagaggccttctcccggaaggagtgggcagcagtcacactgcagtcccaggcccgcatgtggcgcatccgcagacgctattgccaggtgctcaatgctgttcgcatcatccaggcttactggaggtgccgctcctgtgcttcccgggggttcatcaagggccagtacagagtcacagccaaccagctgcatctccagctggagatcttgctggactcagggccttgcattgtgacagagtgtattcccttctcaataaaggaatgaagtggtcttttcca

SEQ ID NO: 144406 - DNA, 578 bp, Homo sapiens
  Payload ID: 8532
  Gene Symbol: IQCF2
  Gene Name: IQ motif containing F2
  Uniprot ID: Q8IXL9
  ENST ID: ENST00000333127
  CDS Start-End: 30-524
agggctaatgaaccatctaaggacaggccatgagggttcgattttgtaccaaaggcaatttaattttggttataattgaggatgttgaagaaagcattgaatggaagacattgcagaagaagaaacagcagaaaatcaaggaaaaacttagaataagaacaaaagcagctgtaaagatccaggcctggtggcggggcaccctggtgcgcaggacactgctgcatgcagccctcagggcctggataattcagtgctggtggcggatgacgctgtcgagggtgctggagaagaaacggcaggcagctctgatcgcctacgcaaccagagagagggcagtgatcaagctccagtctttggtccgtatgtggcgtgtccgctggcgatactgccaggtgctcaatgccatctacatcatccagggccactggcaatgccacaactgccagacctgcgctctcctccagggccactgtgtggtcacagccactcacctgcagttccacattgagatcatcaactcctaagggctggcaagaagggcactgtgtctactgtccctattaaaggtctaacctggt

SEQ ID NO: 144407 - DNA, 1241 bp, Homo sapiens
  Payload ID: 8533
  Gene Symbol: IQCF3
  Gene Name: IQ motif containing F3
  Uniprot ID: P0C7M6
  ENST ID: ENST00000446775
  CDS Start-End: 747-1211
tggctctgcatccccagtaaaactgtgcctgcaacacgtgggatccagtaagtaggagagtcctcacagggaagaagggaaagaaattcctaggatgctggggtgagggtaccccagaagaatgaccaggcagcaggcttgaagagcagctacccagattacacagtggtgcagcggtccatgaaaaaagcagagttgacggattatccaagttttggtggaaagtttgggataaattagtacaaaccatggcaatcaagagctccaggaaaaacagacaggaaatgcatgaaaggctatgtcacagcaatatgccatgttgctaagccatggacaggatataatcacaatgatggaagccctgaatgcttattgaaccaaaaactgtgatgctataatcatatagagaggagagcagaaggatgggaacaggatcttctttttccttgatgttctgaagctacaagatgacttccaataccatgttgaataggagtggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcac

SEQ ID NO: 144408 - DNA, 505 bp, Homo sapiens
  Payload ID: 8533
  Gene Symbol: IQCF3
  Gene Name: IQ motif containing F3
  Uniprot ID: P0C7M6
  ENST ID: ENST00000440739
  CDS Start-End: 41-505
aaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctga

SEQ ID NO: 144409 - DNA, 450 bp, Homo sapiens
  Payload ID: 8533
  Gene Symbol: IQCF3
  Gene Name: IQ motif containing F3
  ENST ID: ENST00000444293
  CDS Start-End: 41-322
aaccagagggagatgatcacctgaaccactgctccaaaccatgggcagtaaatgctgtaaaggtggtccagatgaagatgcagtagaaagacagaggcggcagaagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggt

SEQ ID NO: 144410 - DNA, 1270 bp, Homo sapiens
  Payload ID: 8533
  Gene Symbol: IQCF3
  Gene Name: IQ motif containing F3
  Uniprot ID: P0C7M6
  ENST ID: ENST00000437810
  CDS Start-End: 780-1244
tggctctgcatccccagtaaaactgtgcctgcaacacgtgggatccagtaagtaggagagtcctcacagggaagaagggaaagaaattcctaggatgctggggtgagggtaccccagaagaatgaccaggcagcaggcttgaagagcagctacccagattacacagtggtgcagcggtccatgaaaaaagcagagttgacggattatccaagttttggtggaaagtttgggataaattagtacaaaccatggcaatcaagagctccaggaaaaacagacaggaaatgcatgaaaggctatgtcacagcaatatgccatgttgctaagccatggacaggatataatcacaatgatggaagccctgaatgcttattgaaccaaaaactgtgatgctataatcatatagagaggagagcagaaggatgggaacaggtaaatcttcacttcatgaaaagaagtcaagaggatcttctttttccttgatgttctgaagctacaagatgacttccaataccatgttgaataggagtggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggct

SEQ ID NO: 144411 - DNA, 1685 bp, Homo sapiens
  Payload ID: 8533
  Gene Symbol: IQCF3
  Gene Name: IQ motif containing F3
  Uniprot ID: P0C7M6
  ENST ID: ENST00000456080
  CDS Start-End: 1166-1630
agaagtacagacctgagtataatggagacctctagcctctaatcatgggcactaaaggggattgcagacttgaagggattgaaccaactactgcaagtcatgggcattcaatgttttgtaagagacaaccagtcaattcaaagatgcaggcaggcggagaaggatggccatgttcgccaaagcataatggaagatgttgatgaaaccgcactgttgaaacaaatggagcgggagaaaatgcctcctcctccaaagccaaagcatccagagtggctctgcatccccagtaaaactgtgcctgcaacacgtgggatccagtaagtaggagagtcctcacagggaagaagggaaagaaattcctaggatgctggggtgagggtaccccagaagaatgaccaggcagcaggcttgaagagcagctacccagattacacagtggtgcagcggtccatgaaaaaagcagagttgacggattatccaagttttggtggaaagtttgggataaattagtacaaaccatggcaatcaagagctccaggaaaaacagacaggaaatgcatgaaaggctatgtcacagcaatatgccatgttgctaagccatggacaggatataatcacaatgatggaagccctgaatgcttattgaaccaaaaactgtgatgctataatcatatagagaggagagcagaaggatgggaacaggtaaatcttcacttcatgaaaagaagtcaagaggatcttctttttccttgatgttctgaagctacaagatgacttccaataccatgttgaataggagtggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccaggtattttctctttatccatcaactttgagcctggaaaaggcactgtggcccctggtcatagttgcctttgtgacatcacggccatctctttctccacctttcctgcccctgccaagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggt

SEQ ID NO: 144412 - DNA, 512 bp, Homo sapiens
  Payload ID: 8534
  Gene Symbol: IQCF5
  Gene Name: IQ motif containing F5
  Uniprot ID: A8MTL0
  ENST ID: ENST00000446461
  CDS Start-End: 54-500
cctgatcggaggagtgcgggccggagggtgatgggaccatctagcccctaaccatgggcccagaagagaagaccatcatgacagaaaggtctgcagctgttttcatccaggcctggtggcggggcatgctggtgcgacgcacactgctgcatgcagccctcagggcttggatcattcagtgctggtggaggcaggtgctggagaagctgctggcaaagaggcggaggatggtgttggagttctatgtgcagcaggaatgggcagcagtcaggctgcagtcctgggtccgcatgtggtgtgtccgccagcgttactgtcgtttgctcaacgctgtccgcatcatccaggtctattggcgctggcacagctgccattcccgtgtctttattgagggccactatgaactcaaagaaaaccaacttaatattcaacttgaaatctctttgggcttacaggcttgtaaggtgcaacaatgcataccccttccattaaaagaatgaccaggtctgcta

SEQ ID NO: 144413 - DNA, 446 bp, Homo sapiens
  Payload ID: 8535
  Gene Symbol: IQCF6
  Gene Name: IQ motif containing F6
  Uniprot ID: A8MYZ5
  ENST ID: ENST00000398780
  CDS Start-End: 61-384
ggacttacctgacagttagagaagacagccataaagattcagtcatggtggcgtggaaacatggtgcgccggacgttactgcaggcagcactcagagcctgggtcatccagtgctggtggaggtcaatgcaggccaagatgttggagcaaagacggcgcctggcactaagactctatacctgccaggagtgggcggtggtgaaggtgcaggcacaggttcgaatgtggcaggcccgcaggcggttcctccaggcacgccaagcggcctgcatcatccagtctcactggcgctggcatgccagccaaacccgaggcctgatccggggccactatgaggtcagagccagccggctggagcttgacatcgaaatcctcatgacctagggcgctgacagagccaaggaggctggatctctcttccaataaagacccttactgaccataca

SEQ ID NO: 144414 - DNA, 2262 bp, Homo sapiens
  Payload ID: 8536
  Gene Symbol: IQCG
  Gene Name: IQ motif containing G
  Uniprot ID: Q9H095
  ENST ID: ENST00000265239
  CDS Start-End: 426-1757
gagtggggctgtgggaggaagaaaggctagcgggcgttggccgtatgtgggtgtcttgaggcagtttttcagttctttcatttaccaaagtgacatgcacctactaggtgccaggtgtttagacgtacatacaaccctctgcaaaatctttcagtgtagtcctctgtatgaaaagtttccagccaagaattgccactgcacctgagataagggggatcctggccattaaggaaaccttgccttcgaaactgagccgtgaggaactatacaaaatgggaaattgggacaaatcccagtggctcatgacactaagaagtaaaattacgaactcactgagctggaagtcattcaacgggaattgaataggtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttaga

SEQ ID NO: 144415 - DNA, 1230 bp, Homo sapiens
  Payload ID: 8536
  Gene Symbol: IQCG
  Gene Name: IQ motif containing G
  ENST ID: ENST00000453254
  CDS Start-End: 184-1116
cgaaccctgagtggaggatgttcccgctgcctaaagaatgattgactgtatgaggaggactgcctgcaggaggctttatcgcccttttaggagaactcgtttagctgcctcgtgtccgcacctagtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgaggtaatccctgggacattagccaagaacccaggagatggcaattgagctgtcactcctgatcccctctcagctaacaaaggagggagacaaagatttccctccatctctatcggcaacagcccctccacttgaggttgaaaataaaagcctaaatgagga

SEQ ID NO: 144416 - DNA, 550 bp, Homo sapiens
  Payload ID: 8536
  Gene Symbol: IQCG
  Gene Name: IQ motif containing G
  ENST ID: ENST00000452735
  CDS Start-End: 389-550
gatgttcccgctgcctaaagaatgattgactgtaagattgatttgccaacagtggggtgcttttctctcgatacacacagcaatagacagaacggaaattctgggatcctaatctagcatggaagagaaaggccgggagcacgaaggcagcaggacctcttccttctcttttttctttttctatacttcttttctcccctctacttatttatctctttcaagaaatgagactgggcacagtggctcacgcctgtaaacccagctctttgggaagccgaggcgggaggatcgcttgaggccaggagttcgagaccagcctgggcaacatagtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagag

SEQ ID NO: 144417 - DNA, 712 bp, Homo sapiens
  Payload ID: 8536
  Gene Symbol: IQCG
  Gene Name: IQ motif containing G
  ENST ID: ENST00000416896
  CDS Start-End: 117-712
ctcatgacactaagaagtaaaattacgaactcactgagctggaagtcattcaacgggaattgaatagagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaa

SEQ ID NO: 144418 - DNA, 1981 bp, Homo sapiens
  Payload ID: 8536
  Gene Symbol: IQCG
  Gene Name: IQ motif containing G
  Uniprot ID: Q9H095
  ENST ID: ENST00000455191
  CDS Start-End: 147-1478
agtttacttcctgcgtccccggacgccgtaggtggaaaggcgaaccctgagtggaggatgttcccgctgcctaaagaatgattgactgtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagagattgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgcctttta

SEQ ID NO: 144419 - DNA, 7233 bp, Homo sapiens
  Payload ID: 8537
  Gene Symbol: IQGAP1
  Gene Name: IQ motif containing GTPase activating protein 1
  Uniprot ID: P46940
  ENST ID: ENST00000268182
  CDS Start-End: 125-5098
gacggcacggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttcatgtt

SEQ ID NO: 144420 - DNA, 559 bp, Homo sapiens
  Payload ID: 8537
  Gene Symbol: IQGAP1
  Gene Name: IQ motif containing GTPase activating protein 1
  ENST ID: ENST00000560418
  CDS Start-End: 430-559
agctaccgccgtccgcgcctccaaggtttcacggcttcctcagcagagactcgggctcgtccgccatgtccgccgcagacgaggttgacgggctgggcgtggcccggccgcactatggctgtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagagaaagttctgaagttctcttccttgccactgattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactg

SEQ ID NO: 144421 - DNA, 3602 bp, Homo sapiens
  Payload ID: 8537
  Gene Symbol: IQGAP1
  Gene Name: IQ motif containing GTPase activating protein 1
  ENST ID: ENST00000560738
  CDS Start-End: 82-3339
acttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaact

SEQ ID NO: 144422 - DNA, 350 bp, Homo sapiens
  Payload ID: 8537
  Gene Symbol: IQGAP1
  Gene Name: IQ motif containing GTPase activating protein 1
  ENST ID: ENST00000560373
  CDS Start-End: 1-324
gtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgt

SEQ ID NO: 144423 - DNA, 1201 bp, Homo sapiens
  Payload ID: 8537
  Gene Symbol: IQGAP1
  Gene Name: IQ motif containing GTPase activating protein 1
  ENST ID: ENST00000559809
  CDS Start-End: 1-146
acgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaataaaaagggtgtttgaagtggtgctaataaa

SEQ ID NO: 144424 - DNA, 5863 bp, Homo sapiens
  Payload ID: 8537
  Gene Symbol: IQGAP1
  Gene Name: IQ motif containing GTPase activating protein 1
  ENST ID: ENST00000633485
  CDS Start-End: 96-3671
cggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagttctgtgctttcctacagtgaggcctcgattctagactttctgttcagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctg

SEQ ID NO: 144425 - DNA, 5844 bp, Homo sapiens
  Payload ID: 8538
  Gene Symbol: IQGAP2
  Gene Name: IQ motif containing GTPase activating protein 2
  Uniprot ID: Q13576
  ENST ID: ENST00000274364
  CDS Start-End: 298-5025
cgcggtgaataacggggcctggctggaggagaaaggaaacctgctgcgggaggcggcggcgaccggccagggagcgagggaggagagttcacttttacttcagtgtcagcgcgcggcggccgtggctggctctggcgagagagcaccgagggagtgggtcgcagatcttcgggcggctaggggaaatcggcgagaggcgggatccgagcgcgccggcggggcgcagagcccgcgagcctggccagcgagggtagccgcggggggcgcgccccgggcgggcccccggagacgcgcaggatgccacacgaagagctgccgtcgctgcagagaccccgctatggctctattgtggacgatgaaaggctctctgcagaggagatggatgagaggaggcggcagaacattgcttatgaatatctgtgccacttagaggaagccaaaaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttgtatctgttcaaactaggaatagcaccccagatccaggatttgttgggcaaagtagacttcacagaggaggaaatcagtaatatgagaaaagaacttgagaaatatggaatacagatgccatctttcagcaaaataggtggtattctggccaatgaactgtccgtggatgaagctgcattacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaagaatagctgtatttcagaagaagaaagagatgcttatgaagaactgctgacacaagcagaaatccaaggcaatattaataaagtcaacaggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatgaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacgttatgcaaacacactactctctgttaaactagaagttttatcccaagggcaagataacttaagctggaatgaaattcagaattgtattgatatggttaatgctcaaattcaagaagaaaatgaccgagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgatttttttaaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccattaa

SEQ ID NO: 144426 - DNA, 3376 bp, Homo sapiens
  Payload ID: 8538
  Gene Symbol: IQGAP2
  Gene Name: IQ motif containing GTPase activating protein 2
  Uniprot ID: Q13576
  ENST ID: ENST00000396234
  CDS Start-End: 70-3285
agcagcttgtattcttagaaacgcagcagacagcaactttagcaggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcac

SEQ ID NO: 144427 - DNA, 4255 bp, Homo sapiens
  Payload ID: 8538
  Gene Symbol: IQGAP2
  Gene Name: IQ motif containing GTPase activating protein 2
  ENST ID: ENST00000505766
  CDS Start-End: 48-4255
agaagagggaagtcaagtgtaggaaggagttgtggcaatttaagtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttgtatctgttcaaactaggaatagcaccccagatccaggatttgttgggcaaagtagacttcacagaggaggaaatcagtaatatgagaaaagaacttgagaaatatggaatacagatgccatctttcagcaaaataggtggtattctggccaatgaactgtccgtggatgaagctgcattacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaagaatagctgtatttcagaagaagaaagagatgcttatgaagaactgctgacacaagcagaaatccaaggcaatattaataaagtcaacaggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatgaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacgttatgcaaacacactactctctgttaaactagaagttttatcccaagggcaagataacttaagctggaatgaaattcagaattgtattgatatggttaatgctcaaattcaagaagaaaatgaccgagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaactt

SEQ ID NO: 144428 - DNA, 559 bp, Homo sapiens
  Payload ID: 8538
  Gene Symbol: IQGAP2
  Gene Name: IQ motif containing GTPase activating protein 2
  ENST ID: ENST00000513534
  CDS Start-End: 78-410
aggtgatttcaatcaagtcagctgaaatgcactcacttccaggtgatcggccttggttctgttaagaccatttttggatggggtgttttaaaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatatgggcttttcaacctcggaagcatctgtgagaaacatctgggctttatctccttagcttagaaaaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaag

SEQ ID NO: 144429 - DNA, 1648 bp, Homo sapiens
  Payload ID: 8538
  Gene Symbol: IQGAP2
  Gene Name: IQ motif containing GTPase activating protein 2
  ENST ID: ENST00000514001
  CDS Start-End: 121-1648
agcagcttgtattcttagaaacgcagcagacagcaactttagcaggtgatttcaatcaagtcagctgaaatgcactcacttccaggtgatcggccttggttctgttaagaccatttttggatggggtgttttaaaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggaca

SEQ ID NO: 144430 - DNA, 562 bp, Homo sapiens
  Payload ID: 8538
  Gene Symbol: IQGAP2
  Gene Name: IQ motif containing GTPase activating protein 2
  ENST ID: ENST00000504254
  CDS Start-End: 27-209
aggtgatttcaatcaagtcagctgaaatgcactcacttccaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggataatcgtggctcctgtccagccttccaaggcagaaaaggggaactcttcaaaagaatttgggggagctccacgaaaggtcttaatggttaataaaacttaaacttgaagcctgaccatcccacagcctgctctttacaaaatgcagcaagaatcagaaaatacaaatttcacatgagacttaaaggctagggatatgctaggaagaaattgatctgcggaaacctttcacatcttgattaaattacattagaccaagatttttacaaaggactctgagagtgtttccaaagtgctttggctggatgagatacagcaagccgtcgatgatgccaacgtggacaaggacagagcaaaa

SEQ ID NO: 144431 - DNA, 2617 bp, Homo sapiens
  Payload ID: 8538
  Gene Symbol: IQGAP2
  Gene Name: IQ motif containing GTPase activating protein 2
  ENST ID: ENST00000514350
  CDS Start-End: 144-2617
aaaacaaacagaaagttggcctgctgtctctccaaggtggccctgtcagtgaacccaaggccgaagaccacaggttaatctttgcccaggctggccttggtggcagagctattgtggacgatgaaaggctctctgcagaggagatggatgagaggaggcggcagaacattgcttatgaatatctgtgccacttagaggaagccaaaaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttgtatctgttcaaactaggaatagcaccccagatccaggatttgttgggcaaagtagacttcacagaggaggaaatcagtaatatgagaaaagaacttgagaaatatggaatacagatgccatctttcagcaaaataggtggtattctggccaatgaactgtccgtggatgaagctgcattacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaagaatagctgtatttcagaagaagaaagagatgcttatgaagaactgctgacacaagcagaaatccaaggcaatattaataaagtcaacaggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatgaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacgttatgcaaacacactactctctgttaaactagaagttttatcccaagggcaagataacttaagctggaatgaaattcagaattgtattgatatggttaatgctcaaattcaagaagaaaatgaccgagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagct

SEQ ID NO: 144432 - DNA, 599 bp, Homo sapiens
  Payload ID: 8538
  Gene Symbol: IQGAP2
  Gene Name: IQ motif containing GTPase activating protein 2
  ENST ID: ENST00000509074
  CDS Start-End: 97-599
agcagacagcaactttagcaggtgatttcaatcaagtcagctgaaatgcactcacttccaggtgatcggccttggttctgttaagaccatttttggatggggtgttttaaaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgacggttcatggctcaaactcaacctgcacaaaaaatatgactactattacaacactgattca

SEQ ID NO: 144433 - DNA, 2039 bp, Homo sapiens
  Payload ID: 8538
  Gene Symbol: IQGAP2
  Gene Name: IQ motif containing GTPase activating protein 2
  ENST ID: ENST00000504477
  CDS Start-End: 1-240
gtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcagctcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgatttttttaaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaatt

SEQ ID NO: 144434 - DNA, 3404 bp, Homo sapiens
  Payload ID: 8538
  Gene Symbol: IQGAP2
  Gene Name: IQ motif containing GTPase activating protein 2
  Uniprot ID: Q13576
  ENST ID: ENST00000502745
  CDS Start-End: 91-3306
cagcaactttagcaggtgatttcaatcaagtcagctgaaatgcactcacttccaggtgatcggccttggttctgttaagaccatttttggatggggtgttttaaaggagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttat

SEQ ID NO: 144435 - DNA, 5442 bp, Homo sapiens
  Payload ID: 8538
  Gene Symbol: IQGAP2
  Gene Name: IQ motif containing GTPase activating protein 2
  ENST ID: ENST00000379730
  CDS Start-End: 48-4625
agaagagggaagtcaagtgtaggaaggagttgtggcaatttaagtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataagaagtctggccttcattttcgacacacagataataccgtccagtggttaagagcgatggagtctattggtctacccaagatattttatccagaaacaacagatgtctatgatcggaaaaacataccaagaatgatatattgcattcacgcactgagtttgtatctgttcaaactaggaatagcaccccagatccaggatttgttgggcaaagtagacttcacagaggaggaaatcagtaatatgagaaaagaacttgagaaatatggaatacagatgccatctttcagcaaaataggtggtattctggccaatgaactgtccgtggatgaagctgcattacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaagaatagctgtatttcagaagaagaaagagatgcttatgaagaactgctgacacaagcagaaatccaaggcaatattaataaagtcaacaggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatgaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacgttatgcaaacacactactctctgttaaactagaagttttatcccaagggcaagataacttaagctggaatgaaattcagaattgtattgatatggttaatgctcaaattcaagaagaaaatgaccgagttgtagctgtagggtacatcaatgaagctattgatgaagggaatcctttgaggactttagaaactttgctcctacctactgcgaatattagtgatgtggacccagcccatgcccagcactaccaggatgttttataccatgctaaatcacagaaactcggagactctgagagtgtttccaaagtgctttggctggatgagatacagcaagccgtcgatgatgccaacgtggacaaggacagagcaaaacaatgggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagagtgtctagtgacggttcatggctcaaactcaacctgcacaaaaaatatgactactattacaacactgattcaaaagagagttcctgggtcacacctgaatcatgcttgtataaagaatcatggctcacaggaaaagaaatcgaggacattattgaggaagtcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggctttttggaaaggatataaacaacggaaggagtatatgcacaggcggcaaacgttcattgataatactgattctattgtgaagattcagtcctggttccgaatggcaactgcaagaaagagctatctttcaagactacagtatttcagagatcataataatgaaattgtgaaaatacagtcactgttgagagcgaacaaagctagagatgactacaaaacattggttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggatgtaatttcacatagtaaaaagctgaacaagaaaaaaggaggagaaatggaaatactgaataacaccgacaaccaaggaataaaaagtttgagtaaggagaggagaaaaacactagaaacatatcagcagctgttttaccttttacagaccaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaaatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccagcaagttgccttatgatgtgaccacagaacaagctctaacatacccagaagtgaaaaataaactggaggcttccattgagaacctgagaagggtcaccgacaaagtcctgaattctatcatttcttcccttgatctactgccttatggattgaggtatatagccaaagtactgaagaattcgatccatgagaaattccccgatgcaacagaagatgagctattaaagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggaaatatttcaaagaagcatgtaatgtccctgagccagaagagaagtttaatatggacaaatacacagacctggtgacagtcagcaaaccagtcatttatatttcaattgaagaaatcatcagcacacactcactcctgttggaacaccaggatgcaattgcccctgagaaaaatgacttactgagtgaattgctggggtcgctgggagaggtgccaaccgtggaatcttttcttggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagaccaagaagctgataattgatgtgatccggaaccagccagggaacacattgacagaaatcttagagacaccagcaactgcgcaacaggaggtagaccatgccacggacatggtgagccgtgcaatgatagattccaggactccagaagaaatgaagcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaaaaatactcggagatcaattaaactagatggaaaaggagaacccaaaggggcgaagagagcgaagccagtgaagtacactgcagcaaagctgcatgagaaaggtgtcctgctagatatagatgatcttcaaacaaaccagtttaagaatgttacatttgatatcatagctactgaagatgtaggcattttcgatgtaagatcaaaattccttggtgttgagatggaaaaggtgcaactcaatattcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgatttttttaaaacgaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaaattttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccatt

SEQ ID NO: 144436 - DNA, 5988 bp, Homo sapiens
  Payload ID: 8539
  Gene Symbol: IQGAP3
  Gene Name: IQ motif containing GTPase activating protein 3
  Uniprot ID: Q86VI3
  ENST ID: ENST00000361170
  CDS Start-End: 12-4907
gaaggaggaacatggagaggagagcagcgggcccaggctgggcagcctatgaacgcctcacagctgaggagatggatgagcagaggcggcagaatgttgcctatcagtacctgtgccggctggaggaggccaagcgctggatggaggcctgcctgaaggaggagcttccttccccggtggagctggaggagagccttcggaatggagtgctgctggccaagctaggccactgttttgcaccctccgtggttcccttgaagaagatctacgatgtggagcagctgcggtaccaggcaactggcttacatttccgtcacacagacaacatcaacttttggctatctgcaatagcccacatcggtctgccttcgaccttcttcccagagaccacggacatctatgacaaaaagaacatgccccgggtagtctactgcatccatgctctcagtctcttcctcttccggctgggattggcccctcagatacatgatctatacgggaaagtgaaattcacagctgaggaactcagcaacatggcgtccgaactggccaaatatggcctccagctgcctgccttcagcaagatcgggggcatcttggccaatgagctctcggtggatgaggctgcagtccatgcagctgttcttgccatcaatgaagcagtggagcgaggggtggtggaggacaccctggctgccttgcagaatcccagtgctcttctggagaatctccgagagcctctggcagccgtctaccaagagatgctggcccaggccaagatggagaaggcagccaatgccaggaaccatgatgacagagaaagccaggacatctatgaccactacctaactcaggctgaaatccagggcaatatcaaccatgtcaacgtccatggggctctagaagttgttgatgatgccctggaaagacagagccctgaagccttgctcaaggcccttcaagaccctgccctggccctgcgaggggtgaggagagactttgctgactggtacctggagcagctgaactcagacagagagcagaaggcacaggagctgggcctggtggagcttctggaaaaggaggaagtccaggctggtgtggctgcagccaacacaaagggtgatcaggaacaagccatgctccacgctgtgcagcggatcaacaaagccatccggaggagagtggcggctgacactgtgaaggagctgatgtgccctgaggcccagctgcctccagtgtaccctgttgcatcgtctatgtaccagctggagctggcagtgctccagcagcagcagggggagcttggccaggaggagctcttcgtggctgtggagatgctctcagctgtggtcctgattaaccgggccctggaggcccgggatgccagtggcttctggagcagcctggtgaaccctgccacaggcctggctgaggtggaaggagaaaatgcccagcgttacttcgatgccctgctgaaattgcgacaggagcgtgggatgggtgaggacttcctgagctggaatgacctgcaggccaccgtgagccaggtcaatgcacagacccaggaagagactgaccgggtccttgcagtcagcctcatcaatgaggctctggacaaaggcagccctgagaagactctgtctgccctactgcttcctgcagctggcctagatgatgtcagcctccctgtcgcccctcggtaccatctcctccttgtggcagccaaaaggcagaaggcccaggtgacaggggatcctggagctgtgctgtggcttgaggagatccgccagggagtggtcagagccaaccaggacactaatacagctcagagaatggctcttggtgtggctgccatcaatcaagccatcaaggagggcaaggcagcccagactgagcgggtgttgaggaaccccgcagtggcccttcgaggggtagttcccgactgtgccaacggctaccagcgagccctggaaagtgccatggcaaagaaacagcgtccagcagacacagctttctgggttcaacatgacatgaaggatggcactgcctactacttccatctgcagaccttccaggggatctgggagcaacctcctggctgccccctcaacacctctcacctgacccgggaggagatccagtcagctgtcaccaaggtcactgctgcctatgaccgccaacagctctggaaagccaacgtcggctttgttatccagctccaggcccgcctccgtggcttcctagttcggcagaagtttgctgagcattcccactttctgaggacctggctcccagcagtcatcaagatccaggctcattggcggggttataggcagcggaagatttacctggagtggttgcagtattttaaagcaaacctggatgccataatcaagatccaggcctgggcccggatgtgggcagctcggaggcaatacctgaggcgtctgcactacttccagaagaatgttaactccattgtgaagatccaggcatttttccgagccaggaaagcccaagatgactacaggatattagtgcatgcaccccaccctcctctcagtgtggtacgcagatttgcccatctcttgaatcaaagccagcaagacttcttggctgaggcagagctgctgaagctccaggaagaggtagttaggaagatccgatccaatcagcagctggagcaggacctcaacatcatggacatcaagattggcctgctggtgaagaaccggatcactctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccagactcagcccatctacctggccaagctgatctttcagatgccacagaacaaaaccaccaagttcatggaggcagtgattttcagcctgtacaactatgcctccagccgccgagaggcctatctcctgctccagctgttcaagacagcactccaggaggaaatcaagtcaaaggtggagcagccccaggacgtggtgacaggcaacccaacagtggtgaggctggtggtgagattctaccgtaatgggcggggacagagtgccctgcaggagattctgggcaaggttatccaggatgtgctagaagacaaagtgctcagcgtccacacagaccctgtccacctctataagaactggatcaaccagactgaggcccagacagggcagcgcagccatctcccatatgatgtcaccccggagcaggccttgagccaccccgaggtccagagacgactggacatcgccctacgcaacctcctcgccatgactgataagttccttttagccatcacctcatctgtggaccaaattccgtatgggatgcgatatgtggccaaagtcctgaaggcaactctggcagagaaattccctgacgccacagacagcgaggtctataaggtggtcgggaacctcctgtactaccgcttcctgaacccagctgtggtggctcctgacgccttcgacattgtggccatggcagctggtggagccctggctgccccccagcgccatgccctgggggctgtggctcagctcctacagcacgctgcggctggcaaggccttctctgggcagagccagcacctacgggtcctgaatgactatctggaggaaacacacctcaagttcaggaagttcatccatagagcctgccaggtgccagagccagaggagcgttttgcagtggacgagtactcagacatggtggctgtggccaaacccatggtgtacatcaccgtgggggagctggtcaacacgcacaggctgttgctggagcaccaggactgcattgcccctgatcaccaagaccccctgcatgagctcctggaggatcttggggagctgcccaccatccctgaccttattggtgagagcatcgctgcagatgggcacacggacctgagcaagctagaagtgtccctgacgctgaccaacaagtttgaaggactagaggcagatgctgatgactccaacacccgtagcctgcttctgagcaccaagcagctgttggccgatatcatacagttccatcctggggacaccctcaaggagatcctgtccctctcggcttccagagagcaagaagcagcccacaagcagctgatgagccgacgccaggcctgtacagcccagacaccggagccactgcgacgacaccgctcactgacagctcactccctcctgccactggcagagaagcagcggcgcgtcctgcggaacctacgccgacttgaagccctggggttggtcagcgccagaaatggctaccaggggctagtggacgagctggccaaggacatccgcaaccagcacagacacaggcacaggcggaaggcagagctggtgaagctgcaggccacattacagggcctgagcactaagaccaccttctatgaggagcagggtgactactacagccagtacatccgggcctgcctggaccacctggcccccgactccaagagttctgggaaggggaagaagcagccttctcttcattacactgctgctcagctcctggaaaagggtgtcttggtggaaattgaagatcttcccgcctctcacttcagaaacgtcatctttgacatcacgccgggagatgaggcaggaaagtttgaagtaaatgccaagttcctgggtgtggacatggagcgatttcagcttcactatcaggatctcctgcagctccagtatgagggtgtggctgtcatgaaactcttcaacaaggccaaagtcaatgtcaaccttctcatcttcctcctcaacaagaagtttttgcggaagtgacagaggcaaagggtgctacccaagcccctcttacctctctggatgctttctttaacactaactcaccactgtgcttccctgcagacacctagagctcaggactgggcaaggcccagggattctcaccccttccccagctgggaggagcttgcctgcctggccacagacagtgtatcttctaattggctaaagtgggccttgcccagagtccagctgtgtggcttttatcatgcatgacaaacccctggctttcctgccagatggtaggacatggaccttgacctgggaaagccattactcttgtgtctgctactgccctcccacagtcaccccaatattacaagcactgccccagcggcttgatttcccctctgccttccttctctctgcactcccacaaagccagggccaggctccccatccctacctcccactgcatcagcagtgggtgttcctgcccttcctgagtctaggcagctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcatttttttttttttttttttttttttgagctcaaagagagttctcattttccctattcaaactaatacccatgccgtgttttttaccttggatttaaagtcaccttaggttggggcaacagattctcactcatgtttaagatcttgttatttcagcttcataagatcaaagaggagtctttcccttttctcttttaccctcaggattctcatcccttacagctgactcttccaggcaatttccatagatctgcagtcctgcctctgccacagtctctctgttgtccccacatctacccaacttcctgtactgttgcccttctgatgttaataaaagcagctgttactccca

SEQ ID NO: 144437 - DNA, 5294 bp, Homo sapiens
  Payload ID: 8539
  Gene Symbol: IQGAP3
  Gene Name: IQ motif containing GTPase activating protein 3
  ENST ID: ENST00000491900
  CDS Start-End: 117-4883
gtcctgtctggcggtgccgacggtgaggggcggtggcccaacggcgggagattcaaacctggaagaaggaggaacatggagaggagagcagcgggcccaggctgggcagcctctggatggaggcctgcctgaaggaggagcttccttccccggtggagctggaggagagccttcggaatggagtgctgctggccaagctaggccactgttttgcaccctccgtggttcccttgaagaagatctacgatgtggagcagctgcggtaccaggcaactggcttacatttccgtcacacagacaacatcaacttttggctatctgcaatagcccacatcggtctgccttcgaccttcttcccagagaccacggacatctatgacaaaaagaacatgccccgggtagtctactgcatccatgctctcagtctcttcctcttccggctgggattggcccctcagatacatgatctatacgggaaagtgaaattcacagctgaggaactcagcaacatggcgtccgaactggccaaatatggcctccagctgcctgccttcagcaagatcgggggcatcttggccaatgagctctcggtggatgaggctgcagtccatgcagctgttcttgccatcaatgaagcagtggagcgaggggtggtggaggacaccctggctgccttgcagaatcccagtgctcttctggagaatctccgagagcctctggcagccgtctaccaagagatgctggcccaggccaagatggagaaggcagccaatgccaggaaccatgatgacagagaaagccaggacatctatgaccactacctaactcaggctgaaatccagggcaatatcaaccatgtcaacgtccatggggctctagaagttgttgatgatgccctggaaagacagagccctgaagccttgctcaaggcccttcaagaccctgccctggccctgcgaggggtgaggagagactttgctgactggtacctggagcagctgaactcagacagagagcagaaggcacaggagctgggcctggtggagcttctggaaaaggaggaagtccaggctggtgtggctgcagccaacacaaagggtgatcaggaacaagccatgctccacgctgtgcagcggatcaacaaagccatccggaggagagtggcggctgacactgtgaaggagctgatgtgccctgaggcccagctgcctccagtgtaccctgttgcatcgtctatgtaccagctggagctggcagtgctccagcagcagcagggggagcttggccaggaggagctcttcgtggctgtggagatgctctcagctgtggtcctgattaaccgggccctggaggcccgggatgccagtggcttctggagcagcctggtgaaccctgccacaggcctggctgaggtggaaggagaaaatgcccagcgttacttcgatgccctgctgaaattgcgacaggagcgtgggatgggtgaggacttcctgagctggaatgacctgcaggccaccgtgagccaggtcaatgcacagacccaggaagagactgaccgggtccttgcagtcagcctcatcaatgaggctctggacaaaggcagccctgagaagactctgtctgccctactgcttcctgcagctggcctagatgatgtcagcctccctgtcgcccctcggtaccatctcctccttgtggcagccaaaaggcagaaggcccaggtgacaggggatcctggagctgtgctgtggcttgaggagatccgccagggagtggtcagagccaaccaggacactaatacagctcagagaatggctcttggtgtggctgccatcaatcaagccatcaaggagggcaaggcagcccagactgagcgggtgttgaggaaccccgcagtggcccttcgaggggtagttcccgactgtgccaacggctaccagcgagccctggaaagtgccatggcaaagaaacagcgtccagcagacacagctttctgggttcaacatgacatgaaggatggcactgcctactacttccatctgcagaccttccaggggatctgggagcaacctcctggctgccccctcaacacctctcacctgacccgggaggagatccagtcagctgtcaccaaggtcactgctgcctatgaccgccaacagctctggaaagccaacgtcggctttgttatccagctccaggcccgcctccgtggcttcctagttcggcagaagtttgctgagcattcccactttctgaggacctggctcccagcagtcatcaagatccaggctcattggcggggttataggcagcggaagatttacctggagtggttgcagtattttaaagcaaacctggatgccataatcaagatccaggcctgggcccggatgtgggcagctcggaggcaatacctgaggcgtctgcactacttccagaagaatgttaactccattgtgaagatccaggcatttttccgagccaggaaagcccaagatgactacaggatattagtgcatgcaccccaccctcctctcagtgtggtacgcagatttgcccatctcttgaatcaaagccagcaagacttcttggctgaggcagagctgctgaagctccaggaagaggtagttaggaagatccgatccaatcagcagctggagcaggacctcaacatcatggacatcaagattggcctgctggtgaagaaccggatcactctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccagactcagcccatctacctggccaagctgatctttcagatgccacagaacaaaaccaccaagttcatggaggcagtgattttcagcctgtacaactatgcctccagccgccgagaggcctatctcctgctccagctgttcaagacagcactccaggaggaaatcaagtcaaaggtggagcagccccaggacgtggtgacaggcaacccaacagtggtgaggctggtggtgagattctaccgtaatgggcggggacagagtgccctgcaggagattctgggcaaggttatccaggatgtgctagaagacaaagtgctcagcgtccacacagaccctgtccacctctataagaactggatcaaccagactgaggcccagacagggcagcgcagccatctcccatatgatgtcaccccggagcaggccttgagccaccccgaggtccagagacgactggacatcgccctacgcaacctcctcgccatgactgataagttccttttagccatcacctcatctgtggaccaaattccgtatgggatgcgatatgtggccaaagtcctgaaggcaactctggcagagaaattccctgacgccacagacagcgaggtctataaggtggtcgggaacctcctgtactaccgcttcctgaacccagctgtggtggctcctgacgccttcgacattgtggccatggcagctggtggagccctggctgccccccagcgccatgccctgggggctgtggctcagctcctacagcacgctgcggctggcaaggccttctctgggcagagccagcacctacgggtcctgaatgactatctggaggaaacacacctcaagttcaggaagttcatccatagagcctgccaggtgccagagccagaggagcgttttgcagtggacgagtactcagacatggtggctgtggccaaacccatggtgtacatcaccgtgggggagctggtcaacacgcacaggctgttgctggagcaccaggactgcattgcccctgatcaccaagaccccctgcatgagctcctggaggatcttggggagctgcccaccatccctgaccttattggtgagagcatcgctgcagatgggcacacggacctgagcaagctagaagtgtccctgacgctgaccaacaagtttgaaggactagaggcagatgctgatgactccaacacccgtagcctgcttctgagcaccaagcagctgttggccgatatcatacagttccatcctggggacaccctcaaggagatcctgtccctctcggcttccagagagcaagaagcagcccacaagcagctgatgagccgacgccaggcctgtacagcccagacaccggagccactgcgacgacaccgctcactgacagctcactccctcctgccactggcagagaagcagcggcgcgtcctgcggaacctacgccgacttgaagccctggggttggtcagcgccagaaatggctaccaggggctagtggacgagctggccaaggacatccgcaaccagcacagacacaggcacaggcggaaggcagagctggtgaagctgcaggccacattacagggcctgagcactaagaccaccttctatgaggagcagggtgactactacagccagtacatccgggcctgcctggaccacctggcccccgactccaagagttctgggaaggggaagaagcagccttctcttcattacactgctgctcagctcctggaaaagggtgtcttggtggaaattgaagatcttcccgcctctcacttcagaaacgtcatctttgacatcacgccgggagatgaggcaggaaagtttgaagtaaatgccaagttcctgggtgtggacatggagcgatttcagcttcactatcaggatctcctgcagctccagtatgagggtgtggctgtcatgaaactcttcaacaaggccaaagtcaatgtcaaccttctcatcttcctcctcaacaagaagtttttgcggaagtgacagaggcaaagggtgctacccaagcccctcttacctctctggatgctttctttaacactaactcaccactgtgcttccctgcagacacctagagctcaggactgggcaaggcccagggattctcaccccttccccagctgggaggagcttgcctgcctggccacagacagtgtatcttctaattggctaaagtgggccttgcccagagtccagctgtgtggcttttatcatgcatgacaaacccctggctttcctgccagatggattctcatcccttacagctgactcttccaggcaatttccatagatctgcagtcctgcctctgccacagtctctctgttgtccccacatctacccaacttcctgtactgttgcccttctgatgttaataaaagcagctgttactccca

SEQ ID NO: 144438 - DNA, 4208 bp, Homo sapiens
  Payload ID: 8540
  Gene Symbol: IQCH
  Gene Name: IQ motif containing H
  Uniprot ID: Q86VS3
  ENST ID: ENST00000335894
  CDS Start-End: 67-3150
tccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagataaaggtttcgaagttaatcaaagggtctaacatatccagcctcacggttctgccatcttctcattgcacagatccctatttcactcctataccagtcttacaagcagatgcccacaaagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctaagcatcatatgtgcctggccactcacctgatgtacagtcccaaggcaatcaaaagaataaaaaatctcatccgaggaacagaggcctacatcgtcagcgggctcctccacagagatgatttagctgtggccgatatgttagacatacccatcctgggctctgagcctgaactagctcatctttatagtaccaaatctggaggcaaacgtgtctttgacagtgccaatgtggcagttcctcctggaatatatgatatttatagtcagcaacagatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 144439 - DNA, 3062 bp, Homo sapiens
  Payload ID: 8540
  Gene Symbol: IQCH
  Gene Name: IQ motif containing H
  Uniprot ID: Q86VS3
  ENST ID: ENST00000358767
  CDS Start-End: 1-1866
atgacaaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgagaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtc

SEQ ID NO: 144440 - DNA, 3675 bp, Homo sapiens
  Payload ID: 8540
  Gene Symbol: IQCH
  Gene Name: IQ motif containing H
  ENST ID: ENST00000514049
  CDS Start-End: 97-279
gcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaagatttgtgatcctaatccacctgggacagccccagatatgttcctaagaagaaaccagacttaagaataaaagaacacgtgtcaagagaaacctaagaatgacaaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgagaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtca

SEQ ID NO: 144441 - DNA, 1000 bp, Homo sapiens
  Payload ID: 8540
  Gene Symbol: IQCH
  Gene Name: IQ motif containing H
  Uniprot ID: Q86VS3
  ENST ID: ENST00000512104
  CDS Start-End: 98-604
cgcgcgcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagcgaaagatagggttgaatgtaaaaatcttgcaggatcctgaaaacatccaccacagagctgctgtaaatgcgaactatggaatcagtttgccatatattaatcagagaaaagcatgttaggtcctcaaaggtatgtggaaacaagaagaaatccctggtactgttcatgttccctcactgacatccagttccagttagactttataatacaacacattaagaaatctacagaaaatttgactttgatttattccttttaaataaaaagtgtttcttaaaaggcttgaaacatgtatctgttaacatgaattttaaaagaacaattatgaatgcataacaaaatagccaaaccaaacattgctttgaattgctgcacaaataactgattataactgttatgacctagaaaaaaatcataaaaacatttttctttttggcaagatgtgagttgctgtagaattataccagttctttggttctactttccaaataaatatatatataatgcaatgtaaa

SEQ ID NO: 144442 - DNA, 819 bp, Homo sapiens
  Payload ID: 8540
  Gene Symbol: IQCH
  Gene Name: IQ motif containing H
  ENST ID: ENST00000535744
  CDS Start-End: 50-562
gtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaattcacattgagaagtatttaaatgttgtaaaccagaatgtattaacgacttctgttaatgatgagagcttatatactccccaggcttccaaatggttacttccaactgtaattgatcagaaatcatttattttccctcaggaatctgagggtacattttggcaaccccaaagacagcacagttcatctctgcctgtctttccaagagcaaagcgaaagatagggttgaatgtaaaaatcttgcaggatcctgaaaacatccaccacagagctgctgtaaatgcgaactatggaatcagtttgccatatattaatcagagaaaagcatgtggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggccatgaaagtcaaaacacctttgagagccctgaaatcactgtgggattatgacttttta

SEQ ID NO: 144443 - DNA, 3112 bp, Homo sapiens
  Payload ID: 8540
  Gene Symbol: IQCH
  Gene Name: IQ motif containing H
  Uniprot ID: Q86VS3
  ENST ID: ENST00000546225
  CDS Start-End: 1-2055
atgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttcctacctaaagtgctacaaatgggtgctaaaggagagtagcagatatggccttgaagactggagaaagaaatgggcacaagagccagctttggtgaagatctctgaggagctggcgggcattttagcacagcacgcacagccagtcaatgagaaacggttcccgacgtggaggaaattcctccaaacatttctcagtcaagggggtgtgatcgaagcattcccacctgcagacaatgtcaccaacctcacagtggacatgctgatagagcccaacgggaaaatcagcgtgctgtcgacaggggaccagcttcatgctgaaagccccttcatctcctctggtaccaccgtgcctcagacctcagtggatccccaagttctcacttatttgtgcctccaaattggaaaagcctgcagaatgagagatgtggttggttacttttcgatagatctggtgacttttatagatccaagcaccttggaacaacaggtgtgggcaaccggccttaacctcgcatatagtgaccagctggccctgactcaactcaccttatacctgacaaacggccatctggattgcagtttgagcaccctggaagtgccccgctttgttccaaaggaaaggaagaaaaccaaatgcatgagtgcgctgtcaatgccgatgctggcaaccagtcgctatgcagtgatgaccacccagctaagacacagcaatctctcactggttttccactatgtttttctccagatctgtagggcccatggcattggctatgatgttgaggaaaggcaaggaactgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacagtacataacaatttggatcccagtctggaataaaaagggcaatttttttttctgttagaaataaaagccaggggaaattggtttgctttgtgtgctaggaggtgaatcagaacagattataatgaaatgctctttttaaaacattgtttattaagtgatcttattttatttattaaaccaaaacttatttgtgttttcatttgagagtgttgaacaatcccttcttcttctcaaactcagaaaaaagtaatctgataaaagaagaaagttaaaagtcttactgatatcacctccgcatttacttcctcataggcctcaggattatgtagcttttattttttatgttttataaagttttctcctatttctaatagtccatcgatcttctgcatttataggtttgaataaaggcttaagaattgctatttgtcaaaacacaaatgcctttttttcaaagcttcaaattatattgaaattatatttatatgaatttttaagtgactatcattcatcgtgtttttgttataccaagccactattgtctgctattgttgccatttttcaaaaagtaggataagccagcatctagttaaccaaagcatcagaatgtatctaggtggcagtatctgctcttagtttaagatggagtgtagctcgagctctgtagcttgaataaacatttgtattctctagttctccatttaatacagcagtaggattttttcaagtttagttcaacattatactacctttaaaaaggcagactgttaagattgtagtagtgctgactctaactttcagcattcacttcataattgtccaaaaatatttccacatcagtgagctttactgaagggtgaaataaaagcaaattacaacaccaaaaccattattgttttaaagaatgacctttatgtctataaaaatattttagtgtattggggaaaggaataggatttttacctgtggaatttcaataatttgttaactgtgattcagccacaggctaagagtttctgtaataaaattaacatttgtgtgtgtc

SEQ ID NO: 144444 - DNA, 1699 bp, Homo sapiens
  Payload ID: 8540
  Gene Symbol: IQCH
  Gene Name: IQ motif containing H
  ENST ID: ENST00000559568
  CDS Start-End: 50-109
gtgcttggaaaccgcgcctccgcggaggtagccgttccctgacctagccatggcacagaacactgaaaaccacgaccctgtcggatccatcttaatccagggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattaggtataacacttttgcctgcaaatctatcagcaacctctattacccaccacattatggctccttgattgagttcaaggaaggccccttgttttattcaaattggtctcggcaggaaaatgttctcgacatgatgagagtaataacacaggaccctcgcttgaaacggcgtttaatttggggattaagcaaataaagtcattatgtgggggctgctattcagtggagaggtgatttgctgtaattcgctttcatctgtatgaaatgaactaaaaagttgtatttttccccgaaataacagataatgttttcgatcttctttaatgatagaagaacacaggcttgtatgtgttgttgctgttacgccaataagccaggatattgcttgtacactgtttttaatcaaatgtgcagtcaaaatgataagctacattctctgaaattatttagttctaattacgagcagatgggatgctttatttgcacctagggcgcctgagcaaaaggaaatgctgtgtgaacaagaataattaagaagttgaatagtgttttttgcacttaaataatctgcagtttcatgttaattagcactaatgtaattatttaattacatttatgaattggggaacttaaaagctgttgtctgaaacacactggtaaaaaaggtatgccaaaatgacattgggaatttcagaaatttgcattggagtttcttttaagacatgagctactgtcaac

SEQ ID NO: 144445 - DNA, 543 bp, Homo sapiens
  Payload ID: 8540
  Gene Symbol: IQCH
  Gene Name: IQ motif containing H
  ENST ID: ENST00000561339
  CDS Start-End: 1-141
aaattaacaaaattctcacctgaggaaaaaggagagactctagacattcagagtcttgaaacagcaatcaaaaggactgaagtggggttaagaccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggt

SEQ ID NO: 144446 - DNA, 653 bp, Homo sapiens
  Payload ID: 8540
  Gene Symbol: IQCH
  Gene Name: IQ motif containing H
  ENST ID: ENST00000558759
  CDS Start-End: 1-273
actgtttttatattatatgagcacctgaagagacacaagttgggaatgttaacaatcggcgaggatctccagggggtcctcatgacctttgctcgccatctcttcatcatccatcaagaaatatcagcacctaatatgcaaggcgagaccaattttaagaccaccattgctgatattgaaactattctaagagtaacaaaggaaaacaaaatgagatttgaagaggagcaacagtccaaagatgataaaaacctctctaaacccaagaaatgatcctggaatacaatctctctaatccattcgaggggcccattgttcagacacttgacagataggaagtcctacatgcccattagagccgcgcctcgactgaagccagagcaacataaggtccaagagactcattagttcactggcacaatcgtgtcctgagagtaaatgaaaccctctgtctccttatggctctcatctgctctggactttaaaagaaaactgtctccgttttgttcggcacagtagtggatcattcacatggtgagagcccctgcttaacagtacaaaactgttaaatctatcggaaagttttgcatgtgaattttgattagcactcccgaagctcaagctgctggcaatagcgaaacgatttcgccatc

SEQ ID NO: 144447 - DNA, 583 bp, Homo sapiens
  Payload ID: 8540
  Gene Symbol: IQCH
  Gene Name: IQ motif containing H
  ENST ID: ENST00000561357
  CDS Start-End: 1-583
tcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattagggtattcccagcctgtgagagaacatattgccgatttcaacacacagcagaacatgcagctggggaggctgtgtgacatcttagatgccaatgtgaatgtcatctacatctgctcccatcatatgaatgacgagttagtgctgtattacaaaaaaatcctaagtctacatgcagccgtcaaatctgggaaccttgaggacagaagtgacctgcaggacaggttcaaaattatcacacctgaagctgtaaacatcttccctatgatagagcagctgagtcagctgataactgatcacctgcaaatacagcgttggctctttaaaatggactctgagttccgaggaaatgggactgcattttgtgatattccttc

SEQ ID NO: 144448 - DNA, 1822 bp, Homo sapiens
  Payload ID: 8540
  Gene Symbol: IQCH
  Gene Name: IQ motif containing H
  Uniprot ID: Q86VS3
  ENST ID: ENST00000629425
  CDS Start-End: 235-1152
gtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaggattttaagtatgatagaacgagggctgattccaccaacagcaaggattacctttcagaatccacccattacacccagagcagctcctctgcatagttttgatgaagcacgtaagattccaactgtagccactttcactatacctcgggaaccacctccatctccagcagaagtgaagttctttcccaagaaacaaagatcaaaggggaaaagcagaaggtcaagaggacatcatgataggaaggccatgaaagtcaaaacacctttgagagccctgaaatcactgtgggattatgactttttaatttatgatggtgtcatagacaatacagccccagacttcttagcattcaaggaacattttagcttagcttggggaggtattttttctctcttggaacacgtcgagaagtttctcaggaactatgctataccagaagtcaaaataaaagggaataatttggtggccctccttccagagtttgagctgacgaataaacttaccagatatgaccttctctcagtgttagaggacccagctcatgtccaaatgctgataaatcttccagggcaaaggtacaagggccaagatggaaattcggaggccgccatgaagatccaagccacatggaaatgctacaaagcaagaaaattcttcctcttttatcgccagcagaagtgggcatcaggtgtgattgccattgcttggctgttatattgccataagactcgactaaagaagatactaaaggaatcacgtcagagacacctggagaattttcgcattcgagccaagcatctggcagccaactggaatcgcatcaggacctccaggaggactattatccatatcccatcattaggtataacacttttgcctgcaaatctatcagcaacctctattacccaccacattatggctccttgattgagttcaaggaaggccccttgttttattcaaattggtctcggcaggaaaatgttctcgacatgatgagagtaataacacaggaccctcgcttgaaacggcgtttaatttggggattaagcaaataaagtcattatgtgggggctgctattcagtggagaggtgatttgctgtaattcgctttcatctgtatgaaatgaactaaaaagttgtatttttccccgaaataacagataatgttttcgatcttctttaatgatagaagaacacaggcttgtatgtgttgttgctgttacgccaataagccaggatattgcttgtacactgtttttaatcaaatgtgcagtcaaaatgataagctacattctctgaaattatttagttctaattacgagcagatgggatgctttatttgcacctagggcgcctgagcaaaaggaaatgctgtgtgaacaagaataattaagaagttgaatagtgttttttgcacttaaataatctgcagtttcatgttaattagcactaatgtaattatttaattacatttatgaattggggaacttaaaagctgttgtctgaaacacactggtaaaaaaggtatgccaaaatgacattgggaatttcagaaatttgcattggagtttcttttaagacatgagctactgtcaac

SEQ ID NO: 144449 - DNA, 1460 bp, Homo sapiens
  Payload ID: 8541
  Gene Symbol: IQCJ
  Gene Name: IQ motif containing J
  Uniprot ID: Q1A5X6
  ENST ID: ENST00000397832
  CDS Start-End: 106-444
tcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacacccgtgagtgtcatgtttctttttctatgtcctgacttgacattcaactgaaagcctagactttggttctaagagagaaatcttgggatgtgagcaggtggtttgtgacagtgaagatctatgtagcttatttgctacccaggaacccatggtgagagttttgtcacctcaaaataaagacacaattcataagcacaaagtgaactttatcaagtctggagaaaatagattgcatttatgtgttctcatttctctattatggaggtatcttttttgcttttctttataatagcatatttcttttagtatgtgctgtgtgtttcttttattgtgtggtgctaatatgatagaagataagattggttataaggagtagaaagagaacttttaccagaagaattgaaagtggtcacacactcaggggttgcaacttaaatgtctccaggggccaggtaagtcaccctcatgactgaggtggctgagctgtgcccctggctacacggagaacatagacctcacctgaagggcagcgcacttggctcctgacaatgtgacaccatgtggcgatacaggcaggcatggccaaatgtgattttctttcttcaggacatgtcagaaatctgcatttttaagtgttagcagccagtaagaaaatttaaaaggtaaagtaagcatgcctacagaccacaattgacctacaggccaccagtttaagaaatctgagatagagagttaaggaataagggaatctgctggaagtctttatttttaaaaaacaccaaaagtgggaagaaatcagtgatgagggatttatgaaccaggattttgtggatttaagcattgtgataatttgtaaccagtcactgaaatgctgaaaagttagagaaatgaagtaattacacaagtatattacttccaaaaatttttcttttacttttggttatcatgtttattctgtggtaaaaaggtttcccaacactcaacgcaatgtattctttttgggatcaggtaaaagttactgtatttgaaatgttttcagatggttgcattgcatattcttcaataaa

SEQ ID NO: 144450 - DNA, 885 bp, Homo sapiens
  Payload ID: 8541
  Gene Symbol: IQCJ
  Gene Name: IQ motif containing J
  Uniprot ID: Q1A5X6
  ENST ID: ENST00000451172
  CDS Start-End: 106-585
tcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacaccctttgccagggcccctgttgggaagattcatccttacatctcttggaggttgcagtcacctggggacaagttgcctggtggaaggaaggtgattcttctctaccttgaccagcttgccagacccactgggttcatacatactctcaaggagccccagatagaaagacttggttttctcaccctccagtgaatggacctcaagtttatggagggaataggatgatccctggcctacactgactaagcctgtcatcaagaaatgagcttcctctaacaaccatgagtccatttggaacttctgtgttaaaagccttcagtccaagtcaaatgttgtcagtgagctgtgtccctggggagttctttatgccctgcctcttgcttgatcttttccaggttgttgaacctcagccctctttctctgggtttaatctattgctgttactgcctagacaattttctatcttctcatatctgatcaactgactgtctt

SEQ ID NO: 144451 - DNA, 1408 bp, Homo sapiens
  Payload ID: 8541
  Gene Symbol: IQCJ
  Gene Name: IQ motif containing J
  Uniprot ID: Q1A5X6
  ENST ID: ENST00000482126
  CDS Start-End: 106-504
tcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaacattcagcgagcatggcgagagtacctgcagcggcaggagcccctggggaagaggagcccgtccccaccctctgtctcctcagagaagctgagcagctctgtcagcatgaacaccttctccgacagcagcacaccctttgccagggcccctgttgggaagattcatccttacatctcttggaggttgcagtcacctggggacaagttgcctggtggaaggaaggtgattcttctctaccttgaccagcttgccagacccactgggttcatacatactctcaaggagccccagatagaaagacttggttttctcaccctccagtgaatggacctcaagtttatggagggaataggatgatccctggcctacactgactaagcctgtcatcaagaaatgagcttcctctaacaaccatgagtccatttggaacttctgtgttaaaagccttcagtccaagtcaaatgttgtcagtgagctgtgtccctggggagttctttatgccctgcctcttgcttgatcttttccaggttgttgaacctcagccctctttctctgggtttaatctattgctgttactgcctagacaattttctatcttctcatatctgatcaactgactgtcttgtcccaagtcccttccttccttctactaacctctaacacaaccttaatggaggccaacaagcccttacctaacttctggacattgccagctgctctgcagccccacgcccataactgcaattattgcctatctcaactatctaccccaggcatgcactacacaggaaatcagctcactaatctggttgagttcctgtgtggagctgataatgatgcttttgcatgcttctgctctgattgttttggctaggcctagtggttaatgtggttctttgaacatttctgccttaaaatatataacaaaagtaacgtttaagtatgagtgctcaaattcattatcttaataaaagctgagcacttgttatgtgccaggcactctgctattatcttgtttaatcctatcaatgatcatacaaagaaagacactattattatctccattttacaggtgatgaaaaagagacttaaagagataactaccttttcttgggccacccattgggttggagctccatattttattcttccactatattacttgaaaagaaggctgcatttagacacggtcaagcaatcagttcatgcatttctaagactgctttac

SEQ ID NO: 144452 - DNA, 2423 bp, Homo sapiens
  Payload ID: 8542
  Gene Symbol: IQCK
  Gene Name: IQ motif containing K
  Uniprot ID: Q8N0W5
  ENST ID: ENST00000308214
  CDS Start-End: 700-1269
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacttcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagcccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatggtttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaa

SEQ ID NO: 144453 - DNA, 3482 bp, Homo sapiens
  Payload ID: 8542
  Gene Symbol: IQCK
  Gene Name: IQ motif containing K
  Uniprot ID: Q8N0W5
  ENST ID: ENST00000320394
  CDS Start-End: 700-1563
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacttcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaaggaccagtcttcactttctgcattatccccacattttattcattcatccagattacttcttcagtgcctcaggagtattcttctacaccagctgctgttaaaatgtacaatgaactctagtcccaaggaatacagaagtgctcttattaccagttttcccacttgtggccgcctttgcaaagatccatattctaatttaagtccccaacctctgaatttggttttaagtttacctagtgactgactactctctttataaaaaagaccttatacttaatgatcatttccaaaggagaccactccttaacttttactgcaaacccaacaagatgagacacttaaacccagacagatgtaacaaaggatttttgttgtctaagtcccaaagtattatatagaaagttcctgcttttatgggtaaacttattaccttaatatgttctgtggtttgctgttaaccaagattctcccatttaaaatgccacagaccgaccctcaaggcagatccgaaagcctagtagttagttgcactgggttgttttgacaagctaccacacgtcttaagtaaatagtaaagcctttatttttgtgttaagaacagcattttgaaaataaaacctatctgcccatggtttacagccttttaaatttgtaatatttatatagtcgtttatggtacatattgattgtcttgaaatttctttaacttcttttttataagtatgcaacagtcagccgggggaagataaaggtacattataaaacacacattaatgcatttaataaatatatattatctatcaaaagtgagccttagctcttcatcagttaataaaaagcacctgctgagaactcctgtaagctggtatcatcattgcatcattggattataaaagccacaatgctccctttcaacttggggtttggcctgaggcgttcaactcagccttggccaaccgagaccaccacccgagttcacccttgttcagtgggtcctgacggcatctgggctaaaaaaaaaaaaaaaaaaaagcactgggcgcccagcttccaacaaccagatcttcaactctggaatccctggagatgcacagaacttcccagtttgtaagctgtcagagctgactcccttctcttcccaccctccacctccagtggggagaaatccaggctagaatgacaattttctattaaaaggggggacaagagtggctgttatagacccaaagcgattttaataaccagacacggaacaatttgtgcttacaatgagagattttgatcacagatgctctcctcccgggtcgttttccccaaacgagtcttgtttacacacgcagatcttaaacagaggtgccatttaattttgtctttaaaccttgctccacggggggcagctggctgctacagtctcttggcaaagatgtctcttgatacttttcaggtgtagtcattagaaaaagaacagctctctcccttctcctctcactcccgcctccgcccccattatgaaggcgttcagcccactctcaaccttaaaagccaaaataaaacaaaaccctaagtgcgataacatatcagatttaaaaggggggaaaaaggtctcattaaatgaggcttcccatggctcaaagatggctctgttcttatgctggggaagcacgactttccatggcagccatttgtgctgtgctcaccttatatgcttggacaataaagaacttagaaaacgaa

SEQ ID NO: 144454 - DNA, 280 bp, Homo sapiens
  Payload ID: 8542
  Gene Symbol: IQCK
  Gene Name: IQ motif containing K
  ENST ID: ENST00000568061
  CDS Start-End: 1-177
gcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagactatgcaacagtcagccgggggaagataaaggtacattataaaacacacattaatgcatttaataaatatatattatctatcaaaagtgagccttagctcttcatcagttaataaaaagcacctgctgagaa

SEQ ID NO: 144455 - DNA, 920 bp, Homo sapiens
  Payload ID: 8542
  Gene Symbol: IQCK
  Gene Name: IQ motif containing K
  ENST ID: ENST00000564955
  CDS Start-End: 29-313
gaacgcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaagggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttcttta

SEQ ID NO: 144456 - DNA, 801 bp, Homo sapiens
  Payload ID: 8542
  Gene Symbol: IQCK
  Gene Name: IQ motif containing K
  ENST ID: ENST00000561935
  CDS Start-End: 1-502
ccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagattgattgttccccctggcatctctctactccatgccaactgtcatgaatgtaaactgctcgcagagagtcttggaacacaaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaact

SEQ ID NO: 144457 - DNA, 1774 bp, Homo sapiens
  Payload ID: 8542
  Gene Symbol: IQCK
  Gene Name: IQ motif containing K
  ENST ID: ENST00000568126
  CDS Start-End: 700-984
attaatccctgagacaaaggtactgaaggcaagtggctgaagaacaggcttgattggacagatgacttggagatgttcactggacagggacagccttgtgaagatctttgtgaatacccgacctcgcaagctccagagactacaataattcacttgccctaggttccaaagccagcaagtggaaaacggagactggaattccgcccacaggactccaaagcctgtgcagcaacaccccactcccccggcaggatcaccagcaggacgcgcgggagccaggaagtaagatccgtacctccaaggctcccatgggcccaagcctccgcatcaacagactgggagggattacgtggggtcccagggccggctctgaggcgggaaaactttctggaggcggcggcctcaggccggagcgggcgcacaccgactggaggggtcggattcagggatgtgggtggaccgcatttccccatcttccccgccgcgcacttcctctggtgcaatctccacaccccgcgccggcccgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaagggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaagtaagttgttcgtgtctgactattcagtgatcctaagaattcagtcgtgttaatttgcaagcagaatagcaacaactgacttgaattcttgcttattgttttcttgtcaatcaaacatatggcatcatgaccagccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggtaagaatcatatgcgactgtggtatttgatttaatggggaacttttgtgaggtggagggtccagggtaaaccttagatgagttaggaacaggatattatagctaacatccagacctcagaaatacgattctctgtaaaatgggtcttaaaaagtgatttagaatttttactgaaactggctgggcatagtagctcatggctgtaatcccagaactttgcaggggccaaggtgggaggatcacttgagcccaggagttcaagaccagcctgggcaacatgacgaaacctcgtatctgccaaaaaaaaaaaagaaaa

SEQ ID NO: 144458 - DNA, 946 bp, Homo sapiens
  Payload ID: 8542
  Gene Symbol: IQCK
  Gene Name: IQ motif containing K
  ENST ID: ENST00000561839
  CDS Start-End: 1-370
accgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacataggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaagtgaaatgcaaaatggaggacgatgcagtacctgcagccaagatgaaaattccatcatcttaaccatagctaagacgtatctttgcccattcgagcacaagttaccttgtgcaaggaaaatgtccaaatgatgctctctctcttgtgatttctttaacaagacttggaacatgtgcaaatggaatcttttctgtacaagataggattcattgcaaacaagctttaatgcaaatagtttagaaaagaaagga

SEQ ID NO: 144459 - DNA, 882 bp, Homo sapiens
  Payload ID: 8542
  Gene Symbol: IQCK
  Gene Name: IQ motif containing K
  ENST ID: ENST00000564186
  CDS Start-End: 28-876
aacgcggttaccgtggaaaccgcggccatggcggcaccgcggcaaatccccagccacatagtgcgcctcaagcccagctgctctacagactcgtcgttcacccggacgccggtgcccaccgtgtctctcgcgtcccgcgagctgcctgtctcgtcgtggcaggtcaccgagccgtcaagcaagaatctgtgggagcagatctgcaaggagtatgaagctgagcagcctccctttccagaaggatataaagtcaaacaggagcctgtgattacggttgcgccagtagaggaaatgctttttcatggcttcagtgcagagcactattttccggtttcccatttcaccatgatctcacgtacaccctgtcctcaagataaatcggaaacaatcaacccaaaaacatgttctcccaaagaatatttggaaactttcatctttcctgttctgcttcccggaatggctagcctgcttcaccaagcgaagaaagaaaaatgttttgagaggaaaagaaccaaattcattgcctgtgattttctgactgagtggttatacaaccaaaatccaaagagggcaggggagccattcacagaatttttctccattccatttgtggaggagcggctaaagcaacacccacggccgccaatcccactctcgctcctgctgacagaagaggaagcagccctctacattcaatccttctggagagcctgtgtggttcgctgtgatcctgagattcaagaactgcgtcagtggcagaagaaacttcgcgaggccaagcacattcaccagcaagtcaaaattttctgggccaagcaagaacaaaaaggtaagttgctggattcactgtccttagttcattcaagaaaagcctgattctta

SEQ ID NO: 144460 - DNA, 3336 bp, Homo sapiens
  Payload ID: 8543
  Gene Symbol: IQCA1
  Gene Name: IQ motif containing with AAA domain 1
  Uniprot ID: Q86XH1
  ENST ID: ENST00000254653
  CDS Start-End: 266-2305
gaggttcgcgagtctctgggtcgcgacgggaaggagtgaaacacctctctgcgcctgcgcgctccgtgcctgcgaagcaaacccggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgttcactccctctgctggcgaagttgctgcattgcagaaaaacttgaaaaggtccacaagtagaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttgaa

SEQ ID NO: 144461 - DNA, 3155 bp, Homo sapiens
  Payload ID: 8543
  Gene Symbol: IQCA1
  Gene Name: IQ motif containing with AAA domain 1
  Uniprot ID: Q86XH1
  ENST ID: ENST00000309507
  CDS Start-End: 269-2614
agtgaggttcgcgagtctctgggtcgcgacgggaaggagtgaaacacctctctgcgcctgcgcgctccgtgcctgcgaagcaaacccggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttgaactga

SEQ ID NO: 144462 - DNA, 3281 bp, Homo sapiens
  Payload ID: 8543
  Gene Symbol: IQCA1
  Gene Name: IQ motif containing with AAA domain 1
  Uniprot ID: Q86XH1
  ENST ID: ENST00000409907
  CDS Start-End: 276-2744
tggccgaagtgaggttcgcgagtctctgggtcgcgacgggaaggagtgaaacacctctctgcgcctgcgcgctccgtgcctgcgaagcaaacccggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttgaa

SEQ ID NO: 144463 - DNA, 1606 bp, Homo sapiens
  Payload ID: 8543
  Gene Symbol: IQCA1
  Gene Name: IQ motif containing with AAA domain 1
  ENST ID: ENST00000418802
  CDS Start-End: 1-1606
acagtctcgagggaagagggtctggtggaaggagatgacgccgtctctcagcgctgaggaaaacagaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctc

SEQ ID NO: 144464 - DNA, 3069 bp, Homo sapiens
  Payload ID: 8543
  Gene Symbol: IQCA1
  Gene Name: IQ motif containing with AAA domain 1
  ENST ID: ENST00000431676
  CDS Start-End: 36-2528
gacagtctcgagggaagagggtctggtggaaggagatgacgccgtctctcagcgctgaggaaaacagaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttgaactga

SEQ ID NO: 144465 - DNA, 633 bp, Homo sapiens
  Payload ID: 8544
  Gene Symbol: IQCA1L
  Gene Name: IQ motif containing with AAA domain 1 like
  ENST ID: ENST00000611102
  CDS Start-End: 1-365
ctttgtatgcggtccttcggcttggctccccggatatccacatcatggccccactcatccgctccatcctcctggtgggcccctctggcatggggaagaagatgctggtcaaggcagtgtgcacagaaactggcgccaacctgttcgacctgtcgccggaaaacctgctgggcaaatatcctggcaggaatggggcacagatgatggtgcatatagtctttaaggtccggagcccccagcttttggcatttgcggttctcagacctgtggcaacaaaggaggggggctttgaggtcacgtcacccatcagcctactgggtagcccgactcctacagccctctgtgatttggattggaaatgctgagaagaatttctataagaagacccccaaagaagacaaggagatggacccaaagcggataaagaaggacctcaccaaggccttgcggctgctgactcccggagaccgtgtgatgctgattgggacaacctcccggccacagctggccgagatgcggggtctgtgccgggtctacgagcggatcctcttcatgccccggcctgactacgcatcccgctatgtgctctggaagcgtatgatagaggcccggggcatccagccgacccagcac

SEQ ID NO: 144466 - DNA, 2606 bp, Homo sapiens
  Payload ID: 8544
  Gene Symbol: IQCA1L
  Gene Name: IQ motif containing with AAA domain 1 like
  ENST ID: ENST00000615129
  CDS Start-End: 43-2499
ccaccaccagcaaacaaggggcagcgtggaggagtggacacaatgtctgagggagcttaccagcgcctctgggagtcctcccacgcgaccctgcaggagctgctggaccaagagcagcttctgctcgaacctgcgcccgaccgggagcggcagtccttccagtacaggctcgcatcgctctacctgcactacctggggctgctgcgccgcttcgacaccgtctatgaccagatggtgcagccgcagaagcggcggctgctgcgacgcctgctggacggcgtggcgggccgcgtgctggagctcaaggacgagctggtgcgcgccgacctgtgtgagaaccactgcctggaccgcgtgctgcaggatttcaagctcaccccagctgacctggaggttccaatccccaaatacttcctgctggagcagtccaccactgtgcgggagcgagggctgatactggccgagatcctgtccagactggagccagtgtcctcccagaagagctttacaggaatgcaccggactgaggccataattctagtgcaaaaggcagagcgggcgaggcaaggccggcttcgagccaccttcatgcgagagattcgaagagatgaggagcaggatgggaggattcgggaggatggatggcacaagttcagtcagggccaagcagctgtcaccatacagaaggtgtggaaaggctatctgcagaggaaacgcactcagcaggaccggcgaatggagatggagttcattggcatgctcccctcacccaaccaggtagagcacctgagcatcatctcccagccatgcctcgtggaggatgtccagaggctccgccagatggagaaagaggaggagttccgggcagcaatggtgaaggcccatgattctctggtagagacagaggggcctgacatgaaggagaaaatgaaggagcaaatccgacagtggtttatcgagtgccatgaccttactggccggttccctgattatccagatgcgtcttcaggtggatcctactcaatctttgcagacaaaacgccagaacaggtgagaatggaactggaaatgcagatgcaagagaacagaaaaaaggaacaagagaagagcaaggaaaaaggaaaggatgaaaaagagaagaagaaaggaaaggaagaaaaggccaagaagggggaagtggatgcggtgttgcaagtgttgccatccaaatgtatccctatgatctgtgccgggcatgaagaatacttaaatacatggaagaaccggtgtgagagcatacaccccagtcagaattatgactccgagaccctccgggaggagaagaggaaagaggtggagctggagatccggatacaggtggatgagctgatgcgtcaggagctgaggaagctccgtctggctgtggacaaggaggaagaaagacccctgagggctccaaagaaaacacctgggaagaaaactgggaaaaagaaggaaaaagatctgacctcagacaggtctgtggagtctctgtacgaagagcttgttatttctggccttctaaggaagagtgagtcagtagcattgaaagactacataggtgacttcctgtatcttggatccactctgagtttggtgaagaagttgcccatgccatccctgtttgacatacgacagaatgtggctttgtatgcggtccttcggcttggctccccggatatccacatcatggccccactcatccgctccatcctcctggtgggcccctctggcatggggaagaagatgctggtcaaggcagtgtgcacagaaactggcgccaacctgttcgacctgtcgccggaaaacctgctgggcaaatatcctggcaggaatggggcacagatgatggtgcatatagtctttaaggtagcccgactcctacagccctctgtgatttggattggaaatgctgagaagaatttctataagaagacccccaaagaagacaaggagatggacccaaagcggataaagaaggacctcaccaaggccttgcggctgctgactcccggagaccgtgtgatgctgattgggacaacctcccggccacagctggccgagatgcggggtctgtgccgggtctacgagcggatcctcttcatgccccggcctgactacgcatcccgctatgtgctctggaagcgtatgatagaggcccggggcatccagccgacccagcacctggacatcagtgccctagccaaggtctccgatggctacacgccgggtcacattctccaagccatccaatcggtgctgagtgagcggcggttcctgcaactgtccaagcggcccctggtggcctctgagttcctgggacaactggtgaagctggatccagtgtacagggaggaggaggagtccctgaaggactggtacttcaagaccccactgggcaagaagagcatgaaacacaggatggaccagttggaggccgaggaggccaagctggacaaggagaagaagaaaaggaagtgatggctaaggcttgcgggcacctgagattagtggcgtgggacagggcagtggcccaagggtaaagggatggggcagaggcataaatgcccagatgacttgggaacaaa

SEQ ID NO: 144467 - DNA, 738 bp, Homo sapiens
  Payload ID: 8544
  Gene Symbol: IQCA1L
  Gene Name: IQ motif containing with AAA domain 1 like
  ENST ID: ENST00000613681
  CDS Start-End: 1-356
tgcaagagaacagaaaaaaggaacaagagaagagcaaggaaaaaggaaaggatgaaaaagagaagaagaaaggaaaggaagaaaaggccaagaagggggaagtggatgcggtgttgcaagtgttgccatccaaatgtatccctatgatctgtgccgggcatgaagaatacttaaatacatggaagaaccggtgtgagagcatacaccccagtcagaattatgactccgagaccctccgggaggagaagaggaaagaggtggagctggagatccggatacaggtcacaaagacctcagcgggggatcttcggtttgaattccatctgggggcttctccgcatgttgaaggctgttaagaacagggctcctgagagagcaggaagaggattaggcctgggtgtgaacaggtggatgagctgatgcgtcaggagctgaggaagctccgtctggctgtggacaaggaggaagaaagacccctgagggctccaaagaaaacacctgggaagaaaactgggaaaaagaaggaaaaagatctgacctcagacaggtctgtggagtctctgtacgaagagcttgttatttctggccttctaaggaagagtgagtcagtagcattgaaagactacataggtgacttcctgtatcttggatccactctgagtttggtgaagaagttgcccatgccatccctgtttgacatacgacagaatgtggctttgtatgcggtccttcggcttg

SEQ ID NO: 144468 - DNA, 2633 bp, Homo sapiens
  Payload ID: 8545
  Gene Symbol: IQCJ-SCHIP1
  Gene Name: IQCJ-SCHIP1 readthrough
  ENST ID: ENST00000337808
  CDS Start-End: 578-2041
agaaagagataatctgtgaaagccacagagcctgatttctgctgtgataatcttcagcagaccgaggctggggcgagaatgaggcagacctgtttacatggtgtgtgcagtgccttgtggaattcttaactctattttattgtattatttttaatcgaaaagtagatcagatgatagcatgaagtgaatcggctgctttggactaatgggatcttcttttctgcattaagatcaagaacttttctggaatcctctgttctccgagtagccttgtcttctctgtgtgttttatcaatttgaagaacactggcaaaaatcagcaaacttcatctcccaaaaagctctcgctcttttttgccaatacttgaagatttctgctccaaaatctactttgagctgcttgagcatggtggttgataaccgaagggcaaaagcatcacttatttagtgtgtgttatagaaattttttagacaaccttactagctaacccaggtgaccctttacggatttctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcatatcata

SEQ ID NO: 144469 - DNA, 2067 bp, Homo sapiens
  Payload ID: 8545
  Gene Symbol: IQCJ-SCHIP1
  Gene Name: IQCJ-SCHIP1 readthrough
  ENST ID: ENST00000412423
  CDS Start-End: 67-1491
ctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaac

SEQ ID NO: 144470 - DNA, 583 bp, Homo sapiens
  Payload ID: 8545
  Gene Symbol: IQCJ-SCHIP1
  Gene Name: IQCJ-SCHIP1 readthrough
  ENST ID: ENST00000472451
  CDS Start-End: 154-583
aatttgagggttagttaccggcaggaagtctggttgtgcgagaggaaaggcgggcaggagggaagcctcaggctggtgctggctcccgcccccaggcctccttgggggacgcacctctgacccagcgggcgcagggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggcc

SEQ ID NO: 144471 - DNA, 1884 bp, Homo sapiens
  Payload ID: 8545
  Gene Symbol: IQCJ-SCHIP1
  Gene Name: IQCJ-SCHIP1 readthrough
  ENST ID: ENST00000460298
  CDS Start-End: 242-1597
agagcgagatgcgaaattagtagccgcccacccccttctcagttcccgcccccagggaattataatttcctgggaaagtgtctggttctcggagaatccttggggcggggtaaaggggcgcgcctggcgcaaaatggttaatacaaagtctgcgcgcgccgcggggccccttgtatgaaaagtgtgcgcgctggtggctgggcacccctttgctaatttgagggattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccaggtcagtgtggcttcactcttgccaaagaagaaaagcccagggtggtctgaaatctaagaattaggcaaaaactagctcaagagaacttcttcctctacttccataaataactcacctagccttttctggtgccagctgttcagatggaggggaagcagaattccattgtccttaccaaatgcatgctttttagcaaccatcccccccttgtgatgaattgtcagtgcattacttctcacatctccgcctaaatcaggtctagttctggttttggaggactttaccttgaaggactgtcccctgggaagctgggcataagccatgtcatgctggcatgtttccagcacaagc

SEQ ID NO: 144472 - DNA, 699 bp, Homo sapiens
  Payload ID: 8545
  Gene Symbol: IQCJ-SCHIP1
  Gene Name: IQCJ-SCHIP1 readthrough
  ENST ID: ENST00000467377
  CDS Start-End: 197-699
agcgacttgccgccgcgccccggccaggcacaccttttggggaggcgggggaccaccctgcccggcgtgggccgagagcgccccccaccccgagccttccggcgggtgggaggaggggccggccagggagacgcggaggcgggagtgagacctccgactgccagcggttccttacaaagattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccg

SEQ ID NO: 144473 - DNA, 600 bp, Homo sapiens
  Payload ID: 8545
  Gene Symbol: IQCJ-SCHIP1
  Gene Name: IQCJ-SCHIP1 readthrough
  ENST ID: ENST00000473061
  CDS Start-End: 1-301
cggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccggcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagatt

SEQ ID NO: 144474 - DNA, 1780 bp, Homo sapiens
  Payload ID: 8545
  Gene Symbol: IQCJ-SCHIP1
  Gene Name: IQCJ-SCHIP1 readthrough
  ENST ID: ENST00000476809
  CDS Start-End: 170-1780
ctctttgaggctttctgatgcctagagtgagctcaactcaaaggtttccagcctcacactcgcctcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaacattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtga

SEQ ID NO: 144475 - DNA, 575 bp, Homo sapiens
  Payload ID: 8545
  Gene Symbol: IQCJ-SCHIP1
  Gene Name: IQCJ-SCHIP1 readthrough
  ENST ID: ENST00000481715
  CDS Start-End: 102-575
ttgaaagcaacacttcctatgaacatccagattttctagtcagatctgtaaatatcttacacaacaacagcaagtagaggaaaaatacatttttcacacccatgcaaatggaagaactgaaaagattgcagaatcctctagaacaagttaatgatggaaaatattcatttgaaaacattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccag

SEQ ID NO: 144476 - DNA, 584 bp, Homo sapiens
  Payload ID: 8545
  Gene Symbol: IQCJ-SCHIP1
  Gene Name: IQCJ-SCHIP1 readthrough
  ENST ID: ENST00000483486
  CDS Start-End: 124-584
agatttcactaaaggaatctcattgaaagcaacacttcctatgaacatccagattttctagtcagatctgtaaatatcttacacaacaacagcaagtagaggaaaaatacatttttcacacccatgcaaatggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatga

SEQ ID NO: 144477 - DNA, 484 bp, Homo sapiens
  Payload ID: 8545
  Gene Symbol: IQCJ-SCHIP1
  Gene Name: IQCJ-SCHIP1 readthrough
  ENST ID: ENST00000471575
  CDS Start-End: 182-484
tttttctttcccctctttgaggctttctgatgcctagagtgagctcaactcaaaggtttccagcctcacactcgcctcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaatcaccagctggccatggatgcagagaataatattgaaaagtatcccctcaatctacagcccttggaatcaaagcattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggat

SEQ ID NO: 144478 - DNA, 2445 bp, Homo sapiens
  Payload ID: 8545
  Gene Symbol: IQCJ-SCHIP1
  Gene Name: IQCJ-SCHIP1 readthrough
  ENST ID: ENST00000485419
  CDS Start-End: 170-1861
ctctttgaggctttctgatgcctagagtgagctcaactcaaaggtttccagcctcacactcgcctcacattcccccacagtcacattgcgctctgtgattctgaggaatacagtgtgccagcatccgatccagtctcctttcacctgcaggtgttccagaaacttcaaaatgcgtctggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttc

SEQ ID NO: 144479 - DNA, 574 bp, Homo sapiens
  Payload ID: 8545
  Gene Symbol: IQCJ-SCHIP1
  Gene Name: IQCJ-SCHIP1 readthrough
  ENST ID: ENST00000488898
  CDS Start-End: 302-574
gtgtgtgtgtgtgtgtgtgtgtgtgtgtgtgtgcgtgtgtatggggaggaggtgttgatttttgaaaattgggagagaagagttatattgctgctgcacgagaatttctaccccatgttacctgccttcttaaaactcagtaagcactgaggggaagagatgtggttctgctttggagaacctcagggggacgttgatccgcagtgttcagcaggaattttaggaagaactgaaaagattgcagaatcctctagaacaagttaatgatggaaaatattcatttgaaaatcaccagctggccatggatgcagagaataatattgaaaagtatcccctcaatctacagcccttggaatcaaaggtgaaaatcattcagcgagcatggcgagagtacctgcagcggcaggagcccctggggaagaggagcccgtccccaccctctgtctcctcagagaagctgagcagctctgtcagcatgaacaccttctccgacagcagcacacccgattaccgagaggatgggatggatctaggcagtgacgccggcagcagcagcagcagcagccgcgccagt

SEQ ID NO: 144480 - DNA, 1410 bp, Homo sapiens
  Payload ID: 8545
  Gene Symbol: IQCJ-SCHIP1
  Gene Name: IQCJ-SCHIP1 readthrough
  ENST ID: ENST00000527095
  CDS Start-End: 67-834
ctttcaaagccaatttgaataaacaactcttccctctcaaatgggcaagagtaactcttcagcaccatggagaggtccgggcagcgtgttacaacgtgggactgtgaccagggcaagcactctgacagtgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaac

SEQ ID NO: 144481 - DNA, 2966 bp, Homo sapiens
  Payload ID: 8546
  Gene Symbol:
  Gene Name: Iron/zinc purple acid phosphatase-like protein  [Source:UniProtKB/Swiss-Prot
  Acc:Q6ZNF0]
  Uniprot ID: Q6ZNF0
  ENST ID: ENST00000331256
  CDS Start-End: 275-1591
gtaggcggcaagaggcctcggcacccgcgaactcataaataccggggcggcgctggtggcgggagaggcgcgtgcgggcagccggcgcccccgaggcacctggataaccacccatcttgaaggagacctccctgccctgcctctgttgtcccccagagcactgcctgatcatcctctgttccccatcctcccagcccttcctgctgtacctgtggggagctgatctcctcagtccccctgcttttccccggtctgccatcaccaccccaccaccatgcacccccttcctggctactggtcctgttactgtctactcctgctattctccttgggagtccaggggtccctgggggctcccagcgctgccccagagcaagtccatctgtcttacccaggtgagccaggctccatgactgtaacttggaccacatgggtcccaacccgctctgaagtgcaattcgggttgcagccgtcggggcccctgcccctccgcgcccagggcaccttcgtcccctttgtggacgggggcattctccggcggaagctctacatacaccgagtcacgcttcgcaagctgctgccaggggttcagtatgtttatcgctgtggcagtgcgcagggctggagccgtcggttccgcttcagggccctcaagaatggggcccactggagtccccgtctggctgtgtttggagacctgggggctgacaacccgaaggccgtcccccggctgcgcagggacacccagcagggcatgtatgacgccgttctccatgtgggagactttgcctacaacctggatcaggacaacgcccgtgttggggataggttcatgcggctcattgaacccgtggctgccagcctgccgtacatgacatgccctgggaatcatgaagaacgctacaacttctctaactacaaggctcgcttcagcatgccgggggataatgagggcctgtggtacagctgggatctgggtcccgcccacatcatctccttctccaccgaggtctatttctttctccattatggccgccacttggtacagaggcagtttcgctggctggagagcgacctccagaaagccaataagaaccgggcagcccggccgtggatcatcactatggggcaccggcccatgtactgctccaacgcagatctggacgactgcacacgacatgaaagcaaggtccgcaaaggcctccaaggcaagctgtacgggttggaggatcttttctacaaatatggagtggatctgcagctgtgggctcatgagcactcgtatgaacgactgtggccaatttacaactaccaggtatttaacggcagccgagagatgccctacaccaacccgcgagggcctgtccacatcatcacaggatctgctggctgtgaggagcggctgacgccctttgctgtcttcccgaggccctggagtgccgtgcgtgtgaaggagtacgggtatacgcggctgcacatcctcaacgggacccacatccacatccagcaggtgtcggacgaccaggatgggaagatcgtagatgatgtctgggtggtgagacccctgtttggccggaggatgtacctctagggatggcggcagctctcctccagaagcctaggttttgccgccttggctgctgtgaccagaaactgcccaggcctgggtggggagttgggtgggccctgactcccctgccctccagaggccccatgtagggtacatgcagccctatggagctggggcagctgttccctcctggagaggtgggagtcctggctggctgtggagggagggcaggtgtgcgggcacagagtgacacacggcaggtttctgctggcagggccccaccctcctgcatagctctgatcgggcgaggtgcccacggggcttcaggaatgaagaggcttaagctctggctccatggattctgcacatctgcgggggatgccgctgggcttcctcctctcctgcccacctggcaagggcatcgccaggtgggcacaaccgtcatgacactactcaccagcaggtggcgtcaggggctttttcttctgagcccggcactgagagttggtctgaagcctggctccttcttcactgctccaggactgctatgaagagtcccttcatgcctcagtttcccagcctggcaccatcttattcgggaagaggagacgtgttaacactcttgcctcctagctaggacagatgacaaaccgcaagagccacagacttgccagttccttccctctttccttcctttctttcccttcttttatttattgaatcataatttattgagcatctaccatgtgccaggctctgttctcagtgctggagagacagctgtgaatgagacagagatctcggccctcacagagctgacatcctaaccagagagttggacaaaaatcacgataaatgagttggttaaatagcgatttgtgagtagaaaacgcagggacggtgagagagcagtttcaattttcagggggatctcactgagagggcaacatttgatctgaaggaggtggggaaggagccaagtgggcagacatctgggggaagagcattccaggcagaggaacagccagtgcaaaggccctgagacagaaatgtgcctggccggctgggtacagtaactcacatctgtagtcccagcactttgggaggccgaggcgggcagatcacttgagcccaggagtttgagaccagcctgggcaacacagcgaaaccctttctctaccaaaaatatgaaatttagctgggcatggtggtgtgtgcctgtagtcccagctgctcaggaggctgaggcgggaggatggcttgagcccaggaggttgaggctgcagtgagccatgattgcgccactgcaccccagcctgggcaacagagcaagaccctgtctcaaaaaatatatataaataaaaaagttttaaaaagagaaaaataaacaaagaaa

SEQ ID NO: 144482 - DNA, 2887 bp, Homo sapiens
  Payload ID: 8546
  Gene Symbol:
  Gene Name: Iron/zinc purple acid phosphatase-like protein  [Source:UniProtKB/Swiss-Prot
  Acc:Q6ZNF0]
  ENST ID: ENST00000601575
  CDS Start-End: 224-1327
gaaggaagccggaaggctggaggaagatgcagcgaggctggaaagcacctggataaccacccatcttgaaggagacctccctgccctgcctctgttgtcccccagagcactgcctgatcatcctctgttccccatcctcccagcccttcctgctgtacctgtggggagctgatctcctcagtccccctgcttttccccggtctgccatcaccaccccaccaccatgcacccccttcctggctactggtcctgttactgtctactcctgctattctccttgggagtccaggggtccctgggggctcccagcgctgccccagagcaagtccatctgtcttacccaggtgagccaggctccatgactgtaacttggaccacatgggtcccaacccgctctgaagtgcaattcgggttgcagccgtcggggcccctgcccctccgcgcccagggcaccttcgtcccctttgtggacgggggcattctccggcggaagctctacatacaccgagtcacgcttcgcaagctgctgccaggggttcagtatgtttatcgctgtggcagtgcgcagggctggagccgtcggttccgcttcagggccctcaagaatggggcccactggagtccccgtctggctgtgtttggagacctgggggctgacaacccgaaggccgtcccccggctgcgcagggacacccagcagggcatgtatgacgccgttctccatgtggcaacttctctaactacaaggctcgcttcagcatgccgggggataatgagggcctgtggtacaggtaatgtgggggtgctgggggactggccctctcccctgaaggatgggagatgcaggggagccctggtccctgacccctgccctttgactcctccagctgggatctgggtcccgcccacatcatctccttctccaccgaggtctatttctttctccattatggccgccacttggtacagaggcagtttcgctggctggagagcgacctccagaaagccaataagaaccgggcagcccggccgtggatcatcactatggggcaccggcccatgtactgctccaacgcagatctggacgactgcacacgacatgaaagcaaggtccgcaaaggcctccaaggcaagctgtacgggttggaggatcttttctacaaatatggagtggatctgcagctgtgggctcatgagcactcgtatgaacgactgtggccaatttacaactaccaggtatttaacggcagccgagagatgccctacaccaacccgcgagggcctgtccacatcatcacaggatctgctggctgtgaggagcggctgacgccctttgctgtcttcccgaggccctggagtgccgtgcgtgtgaaggagtacgggtatacgcggctgcacatcctcaacgggacccacatccacatccagcaggtgtcggacgaccaggatgggaagatcgtagatgatgtctgggtggtgagacccctgtttggccggaggatgtacctctagggatggcggcagctctcctccagaagcctaggttttgccgccttggctgctgtgaccagaaactgcccaggcctgggtggggagttgggtgggccctgactcccctgccctccagaggccccatgtagggtacatgcagccctatggagctggggcagctgttccctcctggagaggtgggagtcctggctggctgtggagggagggcaggtgtgcgggcacagagtgacacacggcaggtttctgctggcagggccccaccctcctgcatagctctgatcgggcgaggtgcccacggggcttcaggaatgaagaggcttaagctctggctccatggattctgcacatctgcgggggatgccgctgggcttcctcctctcctgcccacctggcaagggcatcgccaggtgggcacaaccgtcatgacactactcaccagcaggtggcgtcaggggctttttcttctgagcccggcactgagagttggtctgaagcctggctccttcttcactgctccaggactgctatgaagagtcccttcatgcctcagtttcccagcctggcaccatcttattcgggaagaggagacgtgttaacactcttgcctcctagctaggacagatgacaaaccgcaagagccacagacttgccagttccttccctctttccttcctttctttcccttcttttatttattgaatcataatttattgagcatctaccatgtgccaggctctgttctcagtgctggagagacagctgtgaatgagacagagatctcggccctcacagagctgacatcctaaccagagagttggacaaaaatcacgataaatgagttggttaaatagcgatttgtgagtagaaaacgcagggacggtgagagagcagtttcaattttcagggggatctcactgagagggcaacatttgatctgaaggaggtggggaaggagccaagtgggcagacatctgggggaagagcattccaggcagaggaacagccagtgcaaaggccctgagacagaaatgtgcctggccggctgggtacagtaactcacatctgtagtcccagcactttgggaggccgaggcgggcagatcacttgagcccaggagtttgagaccagcctgggcaacacagcgaaaccctttctctaccaaaaatatgaaatttagctgggcatggtggtgtgtgcctgtagtcccagctgctcaggaggctgaggcgggaggatggcttgagcccaggaggttgaggctgcagtgagccatgattgcgccactgcaccccagcctgggcaacagagcaagaccctgtctcaaaaaatatatataaataaaaaagttttaaaaagagaaaaataaacaaagaaa

SEQ ID NO: 144483 - DNA, 736 bp, Homo sapiens
  Payload ID: 8546
  Gene Symbol:
  Gene Name: Iron/zinc purple acid phosphatase-like protein  [Source:UniProtKB/Swiss-Prot
  Acc:Q6ZNF0]
  ENST ID: ENST00000601531
  CDS Start-End: 1-682
gggggctgacaacccgaaggccgtcccccggctgcgcagggacacccagcagggcatgtatgacgccgttctccatgtgggagactttgcctacaacctggatcaggacaacgcccgtgttggggataggttcatgcggctcattgaacccgtggctgccagcctgccgtacatgacatgccctgggaatcatgaagaacgctacaacttctctaactacaaggctcgcttcagcatgccgggggataatgagggcctgtggtacagctgggatctgggtcccgcccacatcatctccttctccaccgaggtctatttctttctccattatggccgccacttggtacagaggcagtttcgctggctggagagcgacctccagaaagccaataagaaccgggcagcccggccgtggatcatcactatggggcaccggcccatgtactgctccaacgcagatctggacgactgcacacgacatgaaagcaaggtccgcaaaggcctccaaggcaagctgtacgggttggaggatcttttctacaaatatggagtggatctgcagctgtgggctcatgagcactcgtatgaacgactgtggccaatttacaactaccaggatgggaagatcgtagatgatgtctgggtggtgagacccctgtttggccggaggatgtacctctagggatggcggcagctctcctccagaagcctaggttttgccgccttggctgctgtg

SEQ ID NO: 144484 - DNA, 1149 bp, Homo sapiens
  Payload ID: 8546
  Gene Symbol:
  Gene Name: Iron/zinc purple acid phosphatase-like protein  [Source:UniProtKB/Swiss-Prot
  Acc:Q6ZNF0]
  ENST ID: ENST00000594229
  CDS Start-End: 35-1039
cttttccccggtctgccatcaccaccccaccaccatgcacccccttcctggctactggtcctgttactgtctactcctgctattctccttgggagtccaggggtccctgggggctcccagcgctgccccagagcaagtccatctgtcttacccaggtgagccaggctccatgactgtaacttggaccacatgggtcccaacccgctctgaagtgcaattcgggttgcagccgtcggggcccctgcccctccgcgcccagggcaccttcgtcccctttgtggacgggggcattctccggcggaagctctacatacaccgagtcacgcttcgcaagctgctgccaggggttcagtatgtttatcgctgtggcagtgcgcagggctggagccgtcggttccgcttcagggccctcaagaatggggcccactggagtccccgtctggctgtgtttggagacctgggggctgacaacccgaaggccgtcccccggctgcgcagggacacccagcagggcatgtatgacgccgttctccatgtggcaacttctctaactacaaggctcgcttcagcatgccgggggataatgagggcctgtggtacagctgggatctgggtcccgcccacatcatctccttctccaccgaggtctatttctttctccattatggccgccacttggtacagaggcagtttcgctggctggagagcgacctccagaaagccaataagaaccgggcagcccggccgtggatcatcactatggggcaccggcccatgtactgctccaacgcagatctggacgactgcacacgacatgaaagcaaggtccgcaaaggcctccaaggcaagctgtacgggttggaggatcttttctacaaatatggagtggatctgcagctgtgggctcatgagcactcgtatgaacgactgtggccaatttacaactaccaggtatttaacggcagccgagagatgccctacaccaacccgcgagggcctgtccacatcatcacaggatctgctgatgggaagatcgtagatgatgtctgggtggtgagacccctgtttggccggaggatgtacctctagggatggcggcagctctcctccagaagcctaggttttgccgccttggctgctgtgaccaga

SEQ ID NO: 144485 - DNA, 6354 bp, Homo sapiens
  Payload ID: 8547
  Gene Symbol: IREB2
  Gene Name: iron-responsive element binding protein 2
  ENST ID: ENST00000258886
  CDS Start-End: 150-3041
gctctgctgctctcgcgatatttgcgcgagcctgcttccttctttcctcccttgccagtccgcctgtcttcctccccgtcttccctgcccggcctcccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaatttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggccgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatggggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatggaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaagtctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgttggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaaggaagtgtaatgtcagacacacaagaaaagcaaatcagtgttgtaagcttaaagtacaatttcaaaggtcactaccaacagcagggttttttttatactttgaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcacattt

SEQ ID NO: 144486 - DNA, 4396 bp, Homo sapiens
  Payload ID: 8547
  Gene Symbol: IREB2
  Gene Name: iron-responsive element binding protein 2
  Uniprot ID: P48200
  ENST ID: ENST00000560440
  CDS Start-End: 55-1086
cccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaaggtaagttaaagttgtggtagctctatgacttactgaacattatttttataaaaattgaagagctctatgagagcagggatttgggttcattactgcatcctcaggtctcttgacgttagccacatcatcatagttatcatagtaataacaacaaacagagcatttagtttgtactaataaatacaaagaaatttgttgtgttcacttatgttagctcatttagtccttataacaagcctgtgagatggatactattactattctcattgtaactctgagaaaactaaggtacagtagggtttagtgacttaccaaagggtcgaaggcctgagtagtaaggggtagagcaaagattccaggcagtcagattcttgagtccattgtcttaaccattatgccttattagtgccttgttgccttaataaacacttgctgactacattattttttttctcttttttacttgaatttaaaaaaaatgtttagcaaaagttgattgtgtcgtctttaattaaattatttgcccattagaaactgttgctctactaagtaatgctttcaaaaacatggactgtagaaatgtgatatatcatttttctgttgccgttttaacatttctctggattattatgtaaaaatcttctctctgaatttttaaaatactggcttcagaacttcaatacatacactgagcttgttaagcatattaatacacaggctcacggatttcctagtgaacaataatttgtaactcttcttcctaaatgtctggcctttgctaactttattttaatgattaaatcctattttgttaaatgaatgtacctggaaaatgttccacatataattccaatttgagtcccaatctcagcatttttggttagattattggtacgaaggctttccggatactccagtgtaaggaaatgataatgcctccctctcagcatttggtattgatccttcttccctaattagaaaagaatttggcatcttagagaaattattgattcaacgtatgataccaaaagatcaagtagtaaattgggaattgcaggattattcctagaggaaaaggagtatcccattatgtttttacagaaatcaattctttactttagacatcctgaaaactaacgctgctttttagccttctctagctgttttttcctgacaatattactgtgtgttttttgacattttagtttaatgttaaaaaattaatctattatatatgtttacatttattgaatatattattacttcttttttgagatcctgttccatttgtgatccttataggaataatcctgtattgtttttttgatgagagcagcatttggtttgtaatatctaatctgtgtttctttcatcctaaaaaataaaaccataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagcttctcgggaggctgaggcaggagaatggcgtgaacccgggaggcggagcttgcagtgagccgagattgcgccactgcagtccgcagtccggcctgggcgacagagcgagactctgtctcaaaaaaaaaaaaaaaaaaaaaaaaaccataaatgaggaaacatctttacacttagggtttgagtttctgtatctataaaaaagggtttggattaagtgatccctggcacttataaaatgttagggcttaatattattcatagatcgaggatagtttcattcttagtcgcctccttagtcactcttcctataccaatctgagaccattttacaatttagaaaagacaaataactggttgggttacttgatagtataataaccaagaaaaataattttagaaggaattaagtttgaaaccacatgttaacaaattctaccaaagtgggatttgcctgtgattaaagatgctgtaaacatttgggccagtagttataatttgaaaaatgtttatagccaatatataattttttatttaaatatacagtttcatcagtctattagtatttcattaagtctaagatgccatcagtggttagcaaacaccactgttttatgcactgctaagaaagaataaagggctgtgtgcagtggctcacacctgtgggacgccaaggcaggagcatcacttgaggccagaagttcaagaccaacctggtcaacattgtaagaccctgtctctacaaaaaaaaaaaagttaaaaattagctgggtgcggtggcacatgcctgtagttccagctactctggaggctaaggtgggaggattgctagagccacggtgttggaagctgcagtgagctgtgaccacaccactgcgctccagcctgggcaacagagtgagaccctgtttctaaaagaaagaaagaaaaagggctgccacctaaacagacacactattgagttgaggtaccctgatttcaaagacatgaaaatgttaattatagccaccttgagctttcaggcccctttctaccctgattaacagtgacattggaccagtcttctctttacttcttatcttaaaatacccccaaaaccagaatgagttgattcataaggacaatgaaggatctcattccttcaccatcactagtattggttaaaaattttattttatagttttcagacaatcgttgctaatcttatctttgcaattttgtatgtgtttctgtgtattccttatatagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggtaagaagataaaagatcactagaataaacatgttacatttccaatgtgtttgataatattttataaattactaccttatccatgttatttactattcacaaaattacattatgttgaaacaacaactttcaagcaaacatcagatgtctttaaagagtgttgtgtcctcaaaccctagttccctgtgacacattgaaagcaatttaaaggaattattcaaaccattgatcctgacttgactgtttccccataatgatggatacctccacctctacttaggggtcataggttgcaatttaatggaagtcagccttaaacatattcacagcagtccccttct

SEQ ID NO: 144487 - DNA, 865 bp, Homo sapiens
  Payload ID: 8547
  Gene Symbol: IREB2
  Gene Name: iron-responsive element binding protein 2
  ENST ID: ENST00000558525
  CDS Start-End: 111-266
ttctttcctcccttgccagtccgcctgtcttcctccccgtcttccctgcccggcctcccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaaatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatc

SEQ ID NO: 144488 - DNA, 558 bp, Homo sapiens
  Payload ID: 8547
  Gene Symbol: IREB2
  Gene Name: iron-responsive element binding protein 2
  ENST ID: ENST00000560840
  CDS Start-End: 444-558
aatgggagagaaccagtcaagattgagatatgtgagattagaaagtggagttatagctggccttggctaaaggcatttctgggagtggaagccagactggaagaggataagaagtgggtgggggagagccgagtatgagcgactctttctggtaagttgctgcgacaggagataatgctgggtaggtggagaacacagggaccggaggagctgaggcggaaggatggagaggcttaagcatgtgttaactgccactgggaagaagtcggcaatcacggaagctaccggagggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaa

SEQ ID NO: 144489 - DNA, 572 bp, Homo sapiens
  Payload ID: 8547
  Gene Symbol: IREB2
  Gene Name: iron-responsive element binding protein 2
  ENST ID: ENST00000559215
  CDS Start-End: 163-303
agacccggggctggctctgctgctctcgcgatatttgcgcgagcctgcttccttctttcctcccttgccagtccgcctgtcttcctccccgtcttccctgcccggcctcccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaagtatgtggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcg

SEQ ID NO: 144490 - DNA, 268 bp, Homo sapiens
  Payload ID: 8547
  Gene Symbol: IREB2
  Gene Name: iron-responsive element binding protein 2
  ENST ID: ENST00000559091
  CDS Start-End: 1-268
gaaatatggttcaggaaactccagagactgggctgccaaaggaccgtatttactgggtgtgaaagctgttttggccgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacaggtatctctaaatttttcaaatatatga

SEQ ID NO: 144491 - DNA, 2917 bp, Homo sapiens
  Payload ID: 8547
  Gene Symbol: IREB2
  Gene Name: iron-responsive element binding protein 2
  ENST ID: ENST00000558570
  CDS Start-End: 30-692
tccccggagggataatatggtctccggcgatggacgccccaaaagcaggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgatggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaatttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggccgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaa

SEQ ID NO: 144492 - DNA, 813 bp, Homo sapiens
  Payload ID: 8548
  Gene Symbol: ISCA1
  Gene Name: iron-sulfur cluster assembly 1
  ENST ID: ENST00000311534
  CDS Start-End: 354-449
tcccgggggtgggcgtccccgggggccgatcgcctccacactcctgccggcctgcgctgttcggccgttccggttaagcagaggctgaacgtgcccggtggcgggggttcccggtggtggcccggagtcctagcctggagacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaa

SEQ ID NO: 144493 - DNA, 1264 bp, Homo sapiens
  Payload ID: 8548
  Gene Symbol: ISCA1
  Gene Name: iron-sulfur cluster assembly 1
  ENST ID: ENST00000326094
  CDS Start-End: 81-341
aatgcgcccgccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggctggagtgcagtggtgtgatctcggcttgctgcaacctccacctccctggttcaagcgatcctcccacctcagcctcccaagtagctgggattataggcgcccaccaccatgcctggttcatttttgtatttttagtggagctgtattatcaactcatgtttttgaggaatcctgtatttccaatttttattcaaagctatttattataatttaatttataattaaaattaattatatttgctgctgcccccttcttccaccctataatctgttaaaacctatctaaaataaataatttatcttgtcattggaagtatgcacttagcttgcagttcttacctacatgggagaatgaggcctagattcctaagtgtgctttcttattaaactaaagttataactatcaataaagaccttttaaaaatgtattattttaaaaattataacacattataaaccttaagattttcatcttaaagaagaggtgacttaattatatattgtttatatttagctaatggctcaatttcttgtaaggaagaaagtttttttgttgtttcgttgttttgtttgtttgttgagacagagtcttgctctcttacccaggctggagtgcagtggcacaatcatggttcactgtagcctctgtctcccgggctcaagcagtcctcccacctcagcctcccgagtagctgggactacaggtgcccaccactgtgcccggctaatttttgtatttttagtggagccagggttttgccctgtttcccagactagaaagctttcttaaattgattgtatttgttggctgggcactgtggctcacacctgtaatcccagcactttgggaggccgaggtgggaggatcacttgagcccaggaatgcaagaccagcttgggccacgtggtgaaaccctgactctaaaaaaattagttggtcc

SEQ ID NO: 144494 - DNA, 1958 bp, Homo sapiens
  Payload ID: 8548
  Gene Symbol: ISCA1
  Gene Name: iron-sulfur cluster assembly 1
  Uniprot ID: Q9BUE6
  ENST ID: ENST00000375991
  CDS Start-End: 72-461
gccgtgtccatggagagaagctgaggcggccgaccttcggcccgaggcaccggggcgccgggacggcgaagatgtcggcttccttagtccgggcaactgtccgggctgtgagcaagaggaagctgcagcccacccgggcagccctcaccctgacaccttcagcagtaaacaagataaaacaacttcttaaagataagcctgagcatgtaggtgtaaaagttggtgtccgaaccaggggctgtaatggcctttcttatactctagaatatacaaagacaaaaggagattctgatgaagaagttattcaagatggagtcagagtattcatcgaaaagaaagcacagctaacacttttaggaacagaaatggactatgttgaagacaaattatccagtgagtttgtgttcaataacccaaacatcaaagggacttgtggctgtggagaaagctttaatatttgaaatctcaggactcttctggccgtaggttccaggaaagctcgtggaagctttggggctcactgcagaaatcatgtgactgtcacgtgctggaaaataaagtgatacatcttgaaaatgaatccagtgtgttggattccagaagaaatgatatttatattctctataggggacagaaaatgagaagccatcactctttttggatcatttaggtctcttgtatcctttgttttagaaccagtttcattaaagttgccttcctgggcacctgtttatccatttcctgaactgtgtgcactccttagatcgctattgatggcttgatcatccctcagcatttctcccaaccagatcggtgactcctaaaatctgagacaggacatcgtgactgctggtagtaatatggtggtgcattgttttttccacccaaacttaacatagcctttttatacatttttatgaaaaatttcattgtcagctgcctcactgcatactctttaatagtaccaggcaaagattttcttcaactatagtacagattagttctgagtgatggtatcaaaaggtgagaaagacgtcatccgcctttttttaatccatttcttttgccaccctatatgtctgttcagagatgggctctcaagctgactttgattcttttagttgagaagtctcttaaagccatctagcccacctccatcaattccctatgtgaggaagcaaaaccccagggaagccaaagggctcctgtccaccctgacaccacaggccgggggagagtagggactctacccccctctccccttgtaggtgacacatgctctgccctctgaggcagtcagcgaaggcaaatggtctgacttctttatgtggtcaacattttgatagaatttctttataatttgatagagattatattatttttattttattttgagtgggaagaattttaaaacctttttatgtcaattaccatcttgtttctttcacctttgaaacaatggtttgtagcagagatgacattgtagcaacccagaattatgcttttggaatgtggtcctcactgtacaggagaatgtgtaatcttttgttaaaattcccagtgtgcatacattttctggttcctcggtccagttgctaaagttcttagtattttagcctaacatatttatcaccaacttttctttaaaagtgttccttttgtcacttagttactgattttcctgggtttgacataagtattctatgagatgatatatatgctttttttgaaagctgattctcatgaattcaagtagctgagttcctttatgtttcgtttattcactaaagtagctgacacaaaacacaccaaaacctagagcggtagttttatgtaaatgctcatgagtttgtatcaataatataattgttgatccacttataattcgtgcaacactgtatgtatgtagagattgagttgtcaattaaaaaaaatgtggcctctttgtgatcataaaa

SEQ ID NO: 144495 - DNA, 851 bp, Homo sapiens
  Payload ID: 8549
  Gene Symbol: ISCA2
  Gene Name: iron-sulfur cluster assembly 2
  ENST ID: ENST00000298818
  CDS Start-End: 20-346
gcggagcttgtggaggaagatggctgccgcctgggggtcgtccctaacggccgcgacgcagagagcggtcactccctggccgaggggcaggctcctcacggcctccctgggaccccaggcgcgtcgggaggcgtcgtcctccagccccgaggccggcgaagggcagatccgcctcacagacagttgcgtccagaggcttttggaaatcaccgaagggtcagaattcctcaggctgcaagtggagggaggtggatgctccggattccaatacaaattttcactggatacagttatcaaccccgacgacaggcaaggaggaagggggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaagaa

SEQ ID NO: 144496 - DNA, 489 bp, Homo sapiens
  Payload ID: 8549
  Gene Symbol: ISCA2
  Gene Name: iron-sulfur cluster assembly 2
  Uniprot ID: Q86U28
  ENST ID: ENST00000554924
  CDS Start-End: 11-193
gtggaggaagatggctgccgcctgggggtcgtccctaacggccgcgacgcagagagcggtcactccctggccgaggggcaggctcctcacggcctccctgggaccccaggcgcgtcgggaggcgtcgtcctccagccccgaggccggcgaagggcagatccgcctcacagacagttgcgtccagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgtta

SEQ ID NO: 144497 - DNA, 2626 bp, Homo sapiens
  Payload ID: 8549
  Gene Symbol: ISCA2
  Gene Name: iron-sulfur cluster assembly 2
  Uniprot ID: Q86U28
  ENST ID: ENST00000556816
  CDS Start-End: 56-520
cgaggccccgggtgagaaacgggggagacgcgaggggcggagcttgtggaggaagatggctgccgcctgggggtcgtccctaacggccgcgacgcagagagcggtcactccctggccgaggggcaggctcctcacggcctccctgggaccccaggcgcgtcgggaggcgtcgtcctccagccccgaggccggcgaagggcagatccgcctcacagacagttgcgtccagaggcttttggaaatcaccgaagggtcagaattcctcaggctgcaagtggagggaggtggatgctccggattccaatacaaattttcactggatacagttatcaaccccgacgacagggtatttgaacagggtggggcaagagtggtggttgactctgatagcttggccttcgtgaaaggggcccaggtggacttcagccaagaactgatccgaagctcatttcaagtgttgaacaatcctcaagcacagcaaggctgctcctgtgggtcatctttctctatcaaactttgatgtgatgactggtgactctgggattgtcaccagttgtaccaatttgaagaacctggaattagtagaattctagaagtttacttctaatcatgtccctctcaattttatttcccgcagtccaggagtgttatgttttgccactattattttcagaatgtgaagattttactcttggcttaatttttccctccactcagtgctaaggctgagcctccagatgctgttacctcagatttaatcactggttgaaactccgtataatctgtagagcctccatggctctaaaatttggaattaacttctcttgccttaagagctgcttgtacatatgtggatagctatgtataaaagcttcattttaaagaaggttcttattgtgttgtggatcagggtcacagattgggtagcttggacaccagttattagaggatgagaaaagtaaatgaaatgttctctttttcacttcaccctgccagaatgtgccacttgacttatctttattgtctatgcaacccatttgccacttcctgtttgataggacagatacattttactctcatgctcgtggatctgctatgagtcataaaaccaagagcccgttacccagaaaacttggaccaaaccctcactgatagtgaattatttcaaaaatagcctccctactcatacagacattttaagattctgtgacaatttaatgactgaatctttttaggatatgttgctttacctgccttctgttgtaaaatggctctggtctcatgcacagcaggaagtgatccctttattgttataggtaatagattcttgggaacctttttttagattgggttaccagatgaaatgtaggatgcccagttaaatttgaatttcaggtaaataattttttagtatgcatatgtctcaaatattgcatatactaaaaattactatttgaaattcaaatttaactcatatttttatttgctgaccttggcaactctgctttagggtcaccaaacagcttttaaaatcacaaattctagtgaattaaagtacttgtgtaggtgtggcacttaaataggcttcggagcttgaaataatcctgttagagtactgtggagctgtgtggacagacagtgaaagaaatctaccaccatcaccacaccgaatgatttattaatactgatgttggagaaactacaaccaagttgattctggaagagttactggttaaatccatcttttgcttgggagcctagaagtttgttacagtaaagacttgcatttctgcactggattggaattaaggtcatttagtaagaatttactatttaaaaaaatggaaatagagtttagaaaatatctgagacagaaacttagatacatttccaacatggcaaaacctaggacttagagaaaacaaacctatcatgcggttagaggagagaaggggacactcagaaacctgagcacatttcttagagctggtggaaggaggcagaaagcagcataccatgggagcatctgtgtgcacacatgaccaagacagtgccgccagtacctgcgcctgatagggtttcagttcagactacctgtcctttcatcctccttaaaaagattttgctacattttaaacattagaatatattctttaagaatatttttgtgggttatttattgattttgtggttttaaaactcttgagcacgagcagaacagcttttgttgctaaatcaatcaaattacagtggtgcactagacagaaacagtcccttagaatgcagcttatatgtgagtatctactgttaatgggagaattggaattttatgtttagaaaaaggcagatttggggctgggcacggtggctcacgcctgtgatcccagcactttgggaggccaaagcaggcagatcacctgaggtcaggagtttgagaccagcctgggcaacatggtgaaaccccatctctactaaaaatacaaaaattaactgcgtggtggacacctgtaatcccagctactcgggagactgaggcaagagaatcacttgaacccaggaggtggagattgcagtgagccaagattgcaccactggactccagcctgggtggcagagtgagactctg

SEQ ID NO: 144498 - DNA, 994 bp, Homo sapiens
  Payload ID: 8550
  Gene Symbol: ISCU
  Gene Name: iron-sulfur cluster assembly enzyme
  Uniprot ID: Q9H1K1
  ENST ID: ENST00000311893
  CDS Start-End: 23-526
ggcgcaggcgcaagccggcaagatggcggcggctggggctttccgtctgaggcgggcggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatgatggtgttctctagtaa

SEQ ID NO: 144499 - DNA, 1069 bp, Homo sapiens
  Payload ID: 8550
  Gene Symbol: ISCU
  Gene Name: iron-sulfur cluster assembly enzyme
  Uniprot ID: Q9H1K1
  ENST ID: ENST00000392807
  CDS Start-End: 189-617
aggcgcaagccggcaagatggcggcggctggggctttccgtctgaggcgggcggcatcggctctgctgctgcggagcccccgcctgcccgcccgggagctgtcggccccggcccgactctatcacaagaaggtatctcaaatctgtgaagtattgtagaggagacacaaaaggaattgggggtcacaaatggttctcattgacatgagtgtagacctttctactcaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccatgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatga

SEQ ID NO: 144500 - DNA, 799 bp, Homo sapiens
  Payload ID: 8550
  Gene Symbol: ISCU
  Gene Name: iron-sulfur cluster assembly enzyme
  ENST ID: ENST00000431221
  CDS Start-End: 23-493
ggcgcaggcgcaagccggcaagatggcggcggctggggctttccgtctgaggcgggcggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaggaaagaaggaatgagaaacattagccttaatgcatcgatggaggtttactaaccaaattagttaaaaatcagcagagagtcaggcctcttgccaagtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctg

SEQ ID NO: 144501 - DNA, 1169 bp, Homo sapiens
  Payload ID: 8550
  Gene Symbol: ISCU
  Gene Name: iron-sulfur cluster assembly enzyme
  ENST ID: ENST00000539580
  CDS Start-End: 18-158
aggcgcaagccggcaagatggcggcggctggggctttccgtctgaggcgggcggcatcggctctgctgctgcggagcccccgcctgcccgcccgggagctgtcggccccggcccgactctatcacaagaaggtatctcaaatctgtgaagtattgtagaggagacacaaaaggaattgggggtcacaaatggttctcattgacatgagtgtagacctttctactcaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatggtattcctgtcgggtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctgtggtttctttcagcccacttttatcgccttaacctagttaatgtatattttgaattgtgtgtatgacctcagaactgaaattgataatgaagttgcaagttttgatagcccgtgaagtgcataagtatctaattttacctgaattgatttggggggaaattaccagtagaatgccttggtctgaatatttgatagaaccaattgttgtacataaaacagattgcgcatatatatatatgtataaaaaataataaaataatggaagatga

SEQ ID NO: 144502 - DNA, 1071 bp, Homo sapiens
  Payload ID: 8550
  Gene Symbol: ISCU
  Gene Name: iron-sulfur cluster assembly enzyme
  ENST ID: ENST00000539593
  CDS Start-End: 14-478
gcaagccggcaagatggcggcggctggggctttccgtctgaggcgggcggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccagtaagtctctgctctccataccagtcagctgggacatttggcagtaatttcaacttggtttgcaacagtccttttagatcatggagcccacgtttgtaaccctcagaattagagctcatgagtctgtccttataacctgcagagggttagagcccccatggtctcacattcatccctaagagaatcatgccagaaggaggtatgcaccagccatcatactgagcacttcatgggcgtaatttctaaacctcacaaatatccttgagtgcacagtagatgtcattacttccctcttatggatgaggaagctaaggcttgggttgagacgcccacatcacatggctaataagtggaagagccagaatttaagctccaatctttgatttcagaatctgtgctgtttccagcagaggagaaaactcagctttcgccataatcctgtttcctgtgtatttcttcacttcctgtctggatggtattcctgtcggggtctgcatctgtatatatggaacaactaagcccagttgtacaatgtccccctccctgctatcctaaaaaaaagcccagatgccttaagacttgtacttggctttccagtttggtctctgtattaaatctaatgctttttccatcatttctt

SEQ ID NO: 144503 - DNA, 1330 bp, Homo sapiens
  Payload ID: 8550
  Gene Symbol: ISCU
  Gene Name: iron-sulfur cluster assembly enzyme
  ENST ID: ENST00000535729
  CDS Start-End: 23-487
ggcgcaggcgcaagccggcaagatggcggcggctggggctttccgtctgaggcgggcggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatggtattcctgtcggggtctgcatctgtatatatggaacaactaagcccagttgtacaatgtccccctccctgctatcctaaaaaaaagcccagatgccttaagacttgtacttggctttccagtttggtctctgtattaaatctaatgctttttccatcatttcttaaccttctcagggaaagaaggaatgagaaacattagccttaatgcatcgatggaggtttactaaccaaattagttaaaaatcagcagagagtcaggcctcttgccaaggtaatactcacagcagaagagccaggtgccggggcagacacactaactcattcttcaggaagcctggtcagacctaagttctttccacttgatctggaattttaagtacccataaagaaaggtcatcacttgtaaacattttcacatggtttcaggaaatccccagcccttttattaggcctttttaggtactgaaacctttagctgatgttctctgttatttgcttgctttctgctgtcattccagctctctcagtttttattttccccatagcctcactttgaatattgactcctaaataaaagtggtcaaactctcgatcactagagggtgatgtggcaaatgccatcccatcaacagattgacatgatcttttttccaaagggcatgtcaacttttttatcatgacaagattttgtccaaagctagactttgatgggagcaggcaagaagtaacatttcctgtgtccctactatgtgtcagacatcttctgtaagtccccacactatcctggcaagaaaagcatgat

SEQ ID NO: 144504 - DNA, 795 bp, Homo sapiens
  Payload ID: 8550
  Gene Symbol: ISCU
  Gene Name: iron-sulfur cluster assembly enzyme
  ENST ID: ENST00000547005
  CDS Start-End: 23-487
ggcgcaggcgcaagccggcaagatggcggcggctggggctttccgtctgaggcgggcggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaaatctgtgctgtttccagcagaggagaaaactcagctttcgccataatcctgtttcctgtgtatttcttcacttcctgtctggatgtgctggctgaagatgcaatcaaggccgccctggctgattacaaattgaaacaagaacccaaaaaaggagaggcagagaagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatacacagtttcattgttctgaatcctg

SEQ ID NO: 144505 - DNA, 1858 bp, Homo sapiens
  Payload ID: 8551
  Gene Symbol: IRX1
  Gene Name: iroquois homeobox 1
  Uniprot ID: P78414
  ENST ID: ENST00000302006
  CDS Start-End: 53-1495
ctccccgcgcctttaatactcgcccgctgcggcggtcgccgagtccgcggacatgtccttcccgcagctgggctacccgcagtacctgagcgccgcggggccgggcgcctacggcggcgagcgcccgggggtgctggccgcggccgctgcggcggctgccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccccgggggcactcaatggagacaaggcctcggtccgcagcagccccacgctcccagagagagacctcgtccccaggccagattcgccggcacagcagttaaagtcgcccttccagccggtacgcgacaactctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctgcgattatcgggttcggtaaatgcccccacgtgcttgtgtctctttccccccttttctgtatatagagtggtttcagattgtaaatagcgcgtcagcgaacttgtctaaatcatatatttttgtctaataaactaaatgaaatgaca

SEQ ID NO: 144506 - DNA, 2456 bp, Homo sapiens
  Payload ID: 8552
  Gene Symbol: IRX2
  Gene Name: iroquois homeobox 2
  Uniprot ID: Q9BZI1
  ENST ID: ENST00000302057
  CDS Start-End: 243-1658
aaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaagtgggcaccctggtgcttcccagaccctgtggagcctcccagcaccaacttgcttaatgtgtttttcttgcttctggtcatggggttagaagacagagcatttcaatcttgtccagcttttctttccttaagggggaaactatattttctgttttatagattccctctttttggcacaagttctatcactcctttacctagggaaggaaaaaaaaaatatatatatatatgtgtgtgtgtgtgtgtgtaatatatatatgtatatatatagtacatgtatatatatagtacatgtgtatatatatattacacactactgttgttttcttttgaaacaatagattattaaaatctgggcatttatatgcaatttagagccatttttactatgctagacacataatagacacatgctttgatgagcttgggctaccaaaacttggagtagcaaaaacctttatagatgatgtttgcaaaataagactgaagagacacgaggcgtactagtcttttatcagccctgtccaacctcccctccacccatgtccaagtggacaggactctgacattctcccggggctcacaacagtatctcaaaaaatatgttgctttgcaacgagtcagaattactaatcatagatcttgaagataagaaagatttggaaccacttcagatcaactcgtttttataatggtgttgttgtggaactgaaagattggggatgatttggttttttccttggtccacaggtaggtgtcacaattgctttg

SEQ ID NO: 144507 - DNA, 2630 bp, Homo sapiens
  Payload ID: 8552
  Gene Symbol: IRX2
  Gene Name: iroquois homeobox 2
  Uniprot ID: Q9BZI1
  ENST ID: ENST00000382611
  CDS Start-End: 250-1665
ctcccccaaaccccgaccgccggcctggcgcgcggctgcgcccaccggctccgcgctgctgccgccgccaccgccaccccgccgccgccccggcccgcgggccgcccaggctagtacccgggccggcctgcctccgccggccgtccgggtgcccgccgccgcgccgcgccccggccgggcgtggatggagggcgccgcgcgccctgcccgctgctcggcgtgacgcgggccccgcgccccgcgcccaccatgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctacctatagaagggccgagcacagcaatgcaagtaggtgtcacaattgctttgaaaaaaaaaaaaaaaaaaaagtcagcaggccattctctcttcccaagctcataaatttacagatacaacaaacagatgtctaaatccagaccacatcttgtgccactgtaaaagagaaggatccacacagcactgtcagcccacagactctaacaattggaacagactattgttggacatatgtgaatttgttggcatagtatagtttccccgatgtatgtgtgacttttgaaaacaatctgtttttctcaggatatcttgaattgatcacttcattgccacggtatatattctataggtgtgataggatttactgtaaagtttatttgtaaaagatgtacacagtagaaataaaacgtgatggaagaacttgagtacttcagaagtggaaacaaatttgatatttatttttataatgatataaagcttctagtaatttatgcaagttgtattgcaatggaatctaaactttttgtaaataaattctgcctggtttttatttgaacattgctggttatacaatctttgttggttgtttaacacgaattctttactaatttatatcttaaattgtaaataaaaacagactagtctacaataatatgatgtttggggcttatttttcctagaagaatgatttggggtagagcgctagtgaataacctccaggtgatctgacctcacctttttaatgaaaacctgtgtgaaataaactctcctttctctcctgagcattgaaaaaaaaaaaaaaaggcagatggaagagaagtatataatcgggagaaacatgtgctgtagatgatttctatacaggtattgcaaaaaaaccaaaaaacataagatttttgtgccctgagtgtgctaattacttgttagtgtaaatttttaaaacttggcaaaataaaatgatctgacacccta

SEQ ID NO: 144508 - DNA, 2601 bp, Homo sapiens
  Payload ID: 8553
  Gene Symbol: IRX3
  Gene Name: iroquois homeobox 3
  Uniprot ID: P78415
  ENST ID: ENST00000329734
  CDS Start-End: 714-2219
cgcgcggcaccctaagtgtccacaacttttggctgccttacttagcccagggcgcagaggctggaaaggtcgcggggagtatcgtgtgagtaaagagagagatttacaaaatagaagtagtgagaaaggaagaagtgaagggaacggaccggagagcaaaagccctcgtgagaaagggaaagagaaggggagaggagaaaggagagtttcatagcgtccagggcagtgcaggagcccgaagcagcggaagcgatcctggggggaagaggagtgcggagaggggaggggagaggaagggcgaggagggggagtgaaaactagaggagggcgaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgccgtcgccgccgcggagcagatcaataggcgaacgcggagcacagcgcagcgcgggcggcagcgcggccccaagcccggcccagcccccgatgcgcgccggagcccgcgggcggcgctgagctgggcggcccgggggtcggcccccctctccgtccgtgccccgcgggccaccatgtccttcccccagctgggataccaatacatccgcccgctttacccgtccgagcgcccgggggccgctggcggcagcggcggcagcgcgggggcccggggcggcctgggtgccggagcctcggagctgaacgcctcggggtccctgtccaacgtgctctcgtccgtgtacggggcgccctacgccgcggccgctgcggccgccgccgcccaaggctacggcgccttcctgccctacgccgcggagctgcccatcttcccgcagctgggcgcgcagtatgagctgaaggacagccccggggtgcagcatccggccgcggctgccgcgtttccgcacccgcaccccgccttctacccgtatggccagtaccagttcggggacccgtcccgtcccaagaacgccaccagggagagcaccagcacgctgaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaggagaataagatgacttgggcgcctcgcagccgcactgacgaggagggaaacgcttatgggagcgagcgcgaggaggaagacgaagaggaggacgaggaggacggcaaacgcgagctagagctggaggaggaggagctcgggggggaggaggaggacacggggggcgagggcctggctgacgacgacgaggacgaggagatcgatttggagaacttagacggcgcggccaccgagcctgagctgtccctggctggggcggcgcgcagggatggcgacctaggcctgggacccatttcggactccaaaaatagcgactcggaagatagctctgagggcttagaggaccggccactaccggtcctgagtctggctccagcgccaccaccagtggccgtggcctcgccgtctctgccgtcgccccccgtgagcctggacccctgcgctcccgcaccagcccccgcctccgccctgcagaagcccaagatctggtccctcgcggagactgccacaagcccggacaacccgcgccgctcgcctcccggcgcgggggggtctccaccgggggcagcggtcgcgccttccgccctgcagctctctccggccgccgccgccgccgccgctcacagactggtctcagcgccgctgggcaagttcccggcttggaccaaccggccgtttccaggcccaccgcccggcccccgcctgcacccgctctccctgctgggctctgcccctccgcacctgctgggacttcccggagccgcgggccacccggctgccgccgccgccttcgctcggccagcggagcccgaaggcggaacagatcgctgtagtgccttggaagtggagaaaaagttactcaagacagctttccagcccgtgcccaggcggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataa

SEQ ID NO: 144509 - DNA, 444 bp, Homo sapiens
  Payload ID: 8553
  Gene Symbol: IRX3
  Gene Name: iroquois homeobox 3
  ENST ID: ENST00000558054
  CDS Start-End: 1-255
gcggccgccgccgcccaaggctacggcgccttcctgccctacgccgcggagctgcccatcttcccgcagctgatcgctgtagtgccttggaagtggagaaaaagttactcaagacagctttccagcccgtgcccaggcggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagttt

SEQ ID NO: 144510 - DNA, 2221 bp, Homo sapiens
  Payload ID: 8554
  Gene Symbol: IRX4
  Gene Name: iroquois homeobox 4
  Uniprot ID: P78413
  ENST ID: ENST00000231357
  CDS Start-End: 120-1679
tcctgcttcgccctcccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaaccaataaaaccgagtgatggtg

SEQ ID NO: 144511 - DNA, 745 bp, Homo sapiens
  Payload ID: 8554
  Gene Symbol: IRX4
  Gene Name: iroquois homeobox 4
  ENST ID: ENST00000511126
  CDS Start-End: 98-745
ctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggatcaaacggctaggcggtcatccccataaaggaattggcctggacctctctggcttgggaaggagcccaggctccctgtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctcc

SEQ ID NO: 144512 - DNA, 1858 bp, Homo sapiens
  Payload ID: 8554
  Gene Symbol: IRX4
  Gene Name: iroquois homeobox 4
  ENST ID: ENST00000508261
  CDS Start-End: 106-696
cccagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacagagggcccagcctgagcccattgcagagcctgtctccaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatgga

SEQ ID NO: 144513 - DNA, 2538 bp, Homo sapiens
  Payload ID: 8554
  Gene Symbol: IRX4
  Gene Name: iroquois homeobox 4
  Uniprot ID: P78413
  ENST ID: ENST00000505790
  CDS Start-End: 458-2017
gaccgcggcgcctggggacgccggcgcgctccgctcgccaggtgctccgcctggaaatgtctccattagttgtcgccggctccccgctggagcgcgcgcgccgagcttccgcgcggagccctcgcgggctgccgggagcggcccagcgccaccgcaggtaggtgaggtcccccgctcccgcccccgccccggggttccgagacccctccccccttccgaggaggcggaggctccgcgcggccgccgaggggagcgggcggcggcggctgcggcgactccccggtgcgtcccgggctgcgagctgctccccgcggccccggcagccacacggcgcgggcgggagcttccccagctcagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaac

SEQ ID NO: 144514 - DNA, 2391 bp, Homo sapiens
  Payload ID: 8554
  Gene Symbol: IRX4
  Gene Name: iroquois homeobox 4
  Uniprot ID: P78413
  ENST ID: ENST00000513692
  CDS Start-End: 276-1835
ggtgcgggctcggctgacgaccgcggcgcctggggacgccggcgcgctccgctcgccaggtgctccgcctggaaatgtctccattagttgtcgccggctccccgctggagcgcgcgcgccgagcttccgcgcggagccctcgcgggctgccgggagcggcccagcgccaccgcagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaaccaataaaaccgagtgatggtgtttgtattgcaaaa

SEQ ID NO: 144515 - DNA, 2398 bp, Homo sapiens
  Payload ID: 8554
  Gene Symbol: IRX4
  Gene Name: iroquois homeobox 4
  Uniprot ID: P78413
  ENST ID: ENST00000622814
  CDS Start-End: 219-1856
aggtgctccgcctggaaatgtctccattagttgtcgccggctccccgctggagcgcgcgcgccgagcttccgcgcggagccctcgcgggctgccgggagcggcccagcgccaccgcagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggatcaaacggctaggcggtcatccccataaaggaattggcctggacctctctggcttgggaaggagcccaggctccctgtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaaccaataaaaccgagtgatggtg

SEQ ID NO: 144516 - DNA, 2403 bp, Homo sapiens
  Payload ID: 8554
  Gene Symbol: IRX4
  Gene Name: iroquois homeobox 4
  Uniprot ID: P78413
  ENST ID: ENST00000613726
  CDS Start-End: 224-1861
gcgcggccgccgaggggagcgggcggcggcggctgcggcgactccccggtgcgtcccgggctgcgagctgctccccgcggccccggcagccacacggcgcgggcgggagcttccccagctcagcgcctagaagcctgcagctccggagcagtggccgcgccacgccggccccagcgcgcagaaccctgcaggccccgcccgtccgccccgggccgcgcccgccatgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccgctgccgcctactacccttacgagccagctctgggccagtacccctatgacaggatcaaacggctaggcggtcatccccataaaggaattggcctggacctctctggcttgggaaggagcccaggctccctgtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcctgaggcgggcgggtcccgagcccaggagggaacccgcgctcaggcggacggcgccgactcttttcactgagtttccagaggaagactagcgcggccaccgcgaagccgccaacccaccggagagggggcttctgaacttggactcctgggaacatggacaagcccggcgctgccacgccggggcctccaccgcctgggcctgagcctgaccgggccattcccaaatttgggacgcggaaggagaggctctcggagcagaagaggccagataccctgaagcataaagtttacgtcaaaagtttacatggagaaggcggttccgttctgaagcgtggtctgctgtcccctgggcgtgaggcctcctgggcctgtcgggcctccgatttcatcctcagcacgtaatgctcaccaacagcacttgcactgagttgactcttgcacactcttgactccataatatgatgctttttaagatgtatgttcacaccaataattgcctgcttcagaggctaatataacaaaaccaataaaaccgagtgatggtg

SEQ ID NO: 144517 - DNA, 2061 bp, Homo sapiens
  Payload ID: 8555
  Gene Symbol: IRX5
  Gene Name: iroquois homeobox 5
  Uniprot ID: P78411
  ENST ID: ENST00000320990
  CDS Start-End: 1-1449
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacagaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtcaaaa

SEQ ID NO: 144518 - DNA, 2401 bp, Homo sapiens
  Payload ID: 8555
  Gene Symbol: IRX5
  Gene Name: iroquois homeobox 5
  Uniprot ID: P78411
  ENST ID: ENST00000394636
  CDS Start-End: 338-1789
cttagcatcttggcaggacctttgcaaaggcaaaagcagagccccccggtgcaaagagcgaggggaaaaaagagaaagcagcaagggaggggaggggaggggaaaaaaagcccagctggggcgagcgaggcgcgcagaggagcgggcgcggcggtcgcagccggaggcgcgcgggaagccagcgaggaggcgccgcgggccggagccccggagccggggccagaggagcggcggcccagggcagccagaggccaggtgcccgcccgctcgccctcgcagggcgccgcccggctcgttggcggccgcggcgcggcgcgccccatgcccgtgtgtggccatgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacagaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtcaaaa

SEQ ID NO: 144519 - DNA, 879 bp, Homo sapiens
  Payload ID: 8555
  Gene Symbol: IRX5
  Gene Name: iroquois homeobox 5
  ENST ID: ENST00000560154
  CDS Start-End: 1-792
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgctgttgaaaaaagaaaaaaagagccttgacttcccttgttttccccccttgcgcccaacgtgcgtccgctcccccgccgagcgcggagtcgcctcagttgcccaggcctctatctgcatggagggccgggccgccgtggccagatctgcgcacgggggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacag

SEQ ID NO: 144520 - DNA, 1825 bp, Homo sapiens
  Payload ID: 8555
  Gene Symbol: IRX5
  Gene Name: iroquois homeobox 5
  Uniprot ID: P78411
  ENST ID: ENST00000558597
  CDS Start-End: 376-1629
aagagccttgacttcccttgttttccccccttgcgcccaacgtgcgtccgctcccccgccgagcgcggagtcgcctcagttgcccaggcctctatctgcatggagggccgggccgccgtggccagatctgcgcacggggtacggacgtgcccgggcagatgggggcctacggggtgacaccgaggccgggacagcttcaggggccccagaaggacctgacccagaaattgaggtccccgctgccttctgaggagggggaggagttgctcctaggtctgaaccccgccagccttgccccgtaggaagctggagtgcgggcctcgtccacccacagaccccggggagcgcagggaaaagggtgcttcggtcgttccgatggcagtggagaccacggtccacactcacctctctgcgtctccaccgcagggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacaaaaaaaaaaatgtcttaaccaaccg

SEQ ID NO: 144521 - DNA, 881 bp, Homo sapiens
  Payload ID: 8555
  Gene Symbol: IRX5
  Gene Name: iroquois homeobox 5
  ENST ID: ENST00000620085
  CDS Start-End: 1-441
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgctgttgaaaaaagaaaaaaagagccttgacttcccttgttttccccccttgcgcccaacgtgcgtccgctcccccgccgagcgcggagtcgcctcagttgcccaggcctctatctgcatggagggccgggccgccgtggccagatctgcgcacgggggctctccctacgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacag

SEQ ID NO: 144522 - DNA, 3128 bp, Homo sapiens
  Payload ID: 8556
  Gene Symbol: IRX6
  Gene Name: iroquois homeobox 6
  Uniprot ID: P78412
  ENST ID: ENST00000290552
  CDS Start-End: 1333-2673
ggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtcctggggaggctgaggcggggaaccagatccccgaggacaaagatgggcgggccagtgggatccaccgacgctgcccggagctgctccaacgagagccgggcctgtggcgtgaacaaactttacttcagcgcaggggcggaggaaccgggctggaggcttctcccccgggcctctgctctcctccacctgccagtgctcagcctccgcccagccttcgcccaccccagctccctccccctcccccacgcgcctctgttcactcagactcctgtctcccctctcccctcctccttctccctcttgcctttctcccccacttttctcctgtctcttcttttgtattctctcctccctcgccgccccggttgcctctcgcctcctccgggccgcaggggaggaggtgagcgcgctgcgcccggggcctgcgcggctcagagggaggcgtttctcctacttctcccgggtaatttggagaggttgtgtgtgtgtgcgcgcgcgcgtgagctccaggcgaaaaggggtaggattcagcgccgagcagagagggtcagggtttttgacgttcctcgccagctgcacaaacctcccggagcaagtgtgagtgtgggtgagagtgcgcgcgcgcgcacgggctggctgcgcttggcacgcttggtggcccagggtcccggggcccggggtcccgtctggcggcccgggattaccgtgacgtcacattgagcctctggccaccttggactgggacacctccggagcctcacagccccgcgccgcgccgcgcctcacctcgccaccacgcgcctttgggaacccgcatcttcttccttcccctgcccatccatgggcccttctgtcttccggaccccacgggccggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccagtttctggcgtcggcaagttccagcaccacatgctgcgaatctacccaacgctctgtctcagatgtggcatcaggctccaccccagcgcccgctctctgctgcgcaccctacgatagtcgactgctgggcagtgcgcgaccggagctgggcgccgccttgggcatctatggagcaccctatgcggccgctgcagctgcccagagctaccctggctacctgccctatagcccagagcccccctcactgtatggggcactgaatccacagtatgaatttaaggaggctgcagggagttttacatccagcctggcacaaccaggagcctattatccctatgagcggactctggggcagtaccaatatgaacggtatggcgcagtggaattgagtggcgccggtcgccgaaagaacgcgacccgggagaccaccagtacactcaaggcctggctcaacgagcaccgcaaaaacccctaccccactaagggtgagaagatcatgctggccatcatcaccaagatgaccctcacccaggtgtccacctggttcgccaacgcacgccggcgcctcaagaaagagaacaaaatgacatgggcgcccaagaacaaaggtggggaggagaggaaggcagagggaggagaggaggactcactaggctgcctaactgctgacaccaaagaagttactgctagccaggaggcccgggggctccggctgagtgacctggaagacctggaggaagaggaggaggaggaggaggaagctgaagacgaggaggtagtggccacagctggggacaggctgacggagttccgaaagggcgcgcagtcactgcctgggccgtgcgctgcagctcgagagggccgattggagcgcagggagtgcggcctggctgcgccccgcttctccttcaatgacccttccggatcggaagaagctgacttcctctcggcggagacaggcagccctaggttgaccatgcactacccatgcttggagaaaccgcgcatctggtctctggcgcacaccgcgacagccagcgctgttgaaggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaagcaggttagcgcaatggctgcgatttgcgaaagaatcttggaaatgggccccacgtttcgaattcatctccaggttaagaagctgccagaccttgccagggaccaggagctctcactttgcctaagagacagacacacagaaaccctcctagcagctgtccttgcacgcagagctggggtggtgggccgacttgaaccttagcagtccccacgggagatggcagggcaccttggggaaggccaagtgggaggctgggaggctgccccacccaccgactctaccaagtctctcttcctcctgtggattcagcaaggcttcctctcctgctcacccctgtctctcacctccaccaaccccactcactttgtaacttcatcactgacccggccaataaggaccctgtgcgtcttctccccctcctaagcccttgtgtccttaaaaataatcagtccgaacccatgta

SEQ ID NO: 144523 - DNA, 711 bp, Homo sapiens
  Payload ID: 8557
  Gene Symbol: ISG15
  Gene Name: ISG15 ubiquitin-like modifier
  Uniprot ID: P05161
  ENST ID: ENST00000379389
  CDS Start-End: 152-649
cgcaggctcggcggcacgccccctgacgtgtgtgcctcaggcttataatagggccggtgctgcctgccgaagccggcggctgagaggcagcgaactcatctttgccagtacaggagcttgtgccgtggcccacagcccacagcccacagccatgggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtacggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaa

SEQ ID NO: 144524 - DNA, 657 bp, Homo sapiens
  Payload ID: 8557
  Gene Symbol: ISG15
  Gene Name: ISG15 ubiquitin-like modifier
  ENST ID: ENST00000624652
  CDS Start-End: 227-657
acgcgtccgtgcagcggaggcttcctgagccccctggagagcctggcctgggcccgggtgtggagaccctcccgggctttcaatccgggcaggaggcagatggcagactcagcagtcacgaatcgcttaattctgaaagtctggtgagaagacacggcgagaatcggggtccagcacagatgatggcgacagcggagaagggaagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtacggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatct

SEQ ID NO: 144525 - DNA, 788 bp, Homo sapiens
  Payload ID: 8557
  Gene Symbol: ISG15
  Gene Name: ISG15 ubiquitin-like modifier
  ENST ID: ENST00000624697
  CDS Start-End: 252-725
cggcctcacgcgtccgtgcagcggaggcttcctgagccccctggagagcctggcctgggcccgggtgtggagaccctcccgggctttcaatccgggcaggaggcagatggcagactcagcagtcacgtaagagaaccgaattaggaatcgcttaattctgaaagtctggtgagaagacacggcgagaatcggggtccagcacagatgatggcgacagcggagaagggaagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtacggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaat

SEQ ID NO: 144526 - DNA, 2459 bp, Homo sapiens
  Payload ID: 8558
  Gene Symbol: ISL1
  Gene Name: ISL LIM homeobox 1
  Uniprot ID: P61371
  ENST ID: ENST00000230658
  CDS Start-End: 282-1331
agttggagcagagaagtttgagtaagagataaggaagagaggtgcccgagccgcgccgagtctgccgccgccgcagcgcctccgctccgccaactccgccggcttaaattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatatgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactaatatccaggggatgacaggaactcccatggtggctgccagtccagagagacacgacggtggcttacaggctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatgaggaacattcattctgtattttttttccctgttggagaaagtgggaaattataatgtcgaactctgaaacaaaagtatttaacgacccagtcaatgaaaactgaatcaagaaatgaatgctccatgaaatgcacgaagtctgttttaatgacaaggtgatatggtagcaacactgtgaagacaatcatgggattttactagaattaaacaacaaacaaaacgcaaaacccagtatatgctattcaatgatcttagaagtactgaaaaaaaaagacgtttttaaaacgtagaggatttatattcaaggatctcaaagaaagcattttcatttcactgcacatctagagaaaaacaaaaatagaaaattttctagtccatcctaatctgaatggtgctgtttctatattggtcattgccttgccaaacaggagctccagcaaaagcgcaggaagagagactggcctccttggctgaaagagtcctttcaggaaggtggagctgcattggtttgatatgtttaaagttgactttaacaaggggttaattgaaatcctgggtctcttggcctgtcctgtagctggtttattttttactttgccccctccccactttttttgagatccatcctttatcaagaagtctgaagcgactataaaggtttttgaattcagatttaaaaaccaacttataaagcattgcaacaaggttacctctattttgccacaagcgtctcgggattgtgtttgacttgtgtctgtccaagaacttttcccccaaagatgtgtatagttattggttaaaatgactgttttctctctctatggaaataaaaaggaaaaaaaaaaaggaaactttttttgtttgctcttgcattgcaaaaattataaagtaatttattatttattgtcggaagacttgccacttttcatgtcatttgacattttttgtttgctgaagtgaaaaaaaaagataaaggttgtacggtggtctttgaattatatgtctaattctatgtgttttgtctttttcttaaatattatgtgaaatcaaagcgccatatgtagaattatatcttcaggactatttcactaataaacatttggcatagataaataaataaacacagtga

SEQ ID NO: 144527 - DNA, 981 bp, Homo sapiens
  Payload ID: 8558
  Gene Symbol: ISL1
  Gene Name: ISL LIM homeobox 1
  ENST ID: ENST00000511384
  CDS Start-End: 1-981
atgggagacatgggagatccaccaaaaaaaaaacgtctgatttccctatgtgttggttgcggcaatcagattcacgatcagtatattctgagggtttctccggatttggaatggcatgcggcatgtttgaaatgtgcggagtgtaatcagtatttggacgagagctgtacatgctttgttagggatgggaaaacctactgtaaaagagattatatcaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgcatccagcgcggccactgcaaatggcagcggagcccatctccgccaggcagccagccctgcggccccacgtccacaagcagccggagaagaccacccgcgtgcggactgtgctgaacgagaagcagctgcacaccttgcggacctgctacgccgcaaacccgcggccagatgcgctcatgaaggagcaactggtagagatgacgggcctcagtccccgtgtgatccgggtctggtttcaaaacaagcggtgcaaggacaagaagcgaagcatcatgatgaagcaactccagcagcagcagcccaatgacaaaactgctaacccagtggaagtacaaagttaccagccaccttggaaagtactgagcgacttcgccttgcagagtgacatagatcagcctgcttttcagcaactggtcaatttttcagaaggaggaccgggctctaattccactggcagtgaagtagcatcaatgtcctctcaacttccagatacacctaacagcatggtagccagtcctattgaggcatga

SEQ ID NO: 144528 - DNA, 1881 bp, Homo sapiens
  Payload ID: 8559
  Gene Symbol: ISL2
  Gene Name: ISL LIM homeobox 2
  Uniprot ID: Q96A47
  ENST ID: ENST00000290759
  CDS Start-End: 161-1240
gctagtgcgtgttgacgtcatgctgcgtgcgggccggtgcggaatcgctccttcaactccgcggggcagtaggagttagttagcaaagagccgaggccgggcgcgcgaccctcgtccttctgcccctggccgcacactttgcgcacatctctttttctgcatggtggatattatttttcattatccttttctgggtgctatgggtgatcattccaagaagaagcccgggacggccatgtgcgtgggctgcgggagtcagatccacgaccagtttatcctgcgggtgtcgcccgacctcgagtggcacgcggcctgcctcaagtgtgccgagtgcagccagtacctggacgagacgtgcacgtgcttcgtgagagacgggaagacctactgcaagcgggactatgtcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccgacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcgggtcatccgcgtctggttccagaacaagcgctgcaaggacaagaagaaatccattctcatgaagcagctgcagcagcagcagcacagcgacaagacgagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgtccccatctcggccggcccggagctcgcccacgcggacccccgccctgccccagctcagcgctccctggcggcttcgcccgggctcctagcggggaaaaggaaggggataactcagaggaacagacactcaaactcccaaagcgcatgattgctgggaaacagtagaaaccagacttgccttgaaagtgtttaagttattcgacggaggacagagtatgtgagcctttgccgaacaaacaaacgtaagttattgttatttattgtgagaacagccagttcatagtgggacttgtattttgatcttaataaaaaataataacccgggg

SEQ ID NO: 144529 - DNA, 1446 bp, Homo sapiens
  Payload ID: 8559
  Gene Symbol: ISL2
  Gene Name: ISL LIM homeobox 2
  ENST ID: ENST00000558656
  CDS Start-End: 77-664
aaagagccgaggccgggcgcgcgaccctcgtccttctgcccctggccgcacactttgcgcacatctctttttctgcatggtggatattatttttcattatccttttctgggtgctatgggtgatcattccaagaagaagcccgggacggccatgtgcgtgggctgcgggagtcagatccacgaccagtttatcctgcgggtgtcgcccgacctcgagtggcacgcggcctgcctcaagtgtgccgagtgcagccagtacctggacgagacgtgcacgtgcttcgtgagagacgggaagacctactgcaagcgggactatgtcagacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcgggtcatccgcgtctggttccagaacaagcgctgcaaggacaagaagaaatccattctcatgaagcagctgcagcagcagcagcacagcgacaagacgagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgtccccatctcggccggcccggagctcgcccacgcggacccccgccctgccccagctcagcgctccctggcggcttcgcccgggctcctagcggggaaaaggaaggggataactcagaggaacagacactcaaactcccaaagcgcatgattgctgggaaacagtagaaaccagacttgccttgaaagtgtttaagttattcgacggaggacagagtatgtgagcctttgccgaacaaac

SEQ ID NO: 144530 - DNA, 1958 bp, Homo sapiens
  Payload ID: 8560
  Gene Symbol: IAPP
  Gene Name: islet amyloid polypeptide
  Uniprot ID: P10997
  ENST ID: ENST00000240652
  CDS Start-End: 137-406
gattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaattta

SEQ ID NO: 144531 - DNA, 409 bp, Homo sapiens
  Payload ID: 8560
  Gene Symbol: IAPP
  Gene Name: islet amyloid polypeptide
  Uniprot ID: P10997
  ENST ID: ENST00000539393
  CDS Start-End: 71-340
agctttgcacatctccaggtcagacctatcctaatatctacatctacatttccagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgccctt

SEQ ID NO: 144532 - DNA, 460 bp, Homo sapiens
  Payload ID: 8560
  Gene Symbol: IAPP
  Gene Name: islet amyloid polypeptide
  ENST ID: ENST00000535428
  CDS Start-End: 1-257
atctgaaagctacacccattgaaagatgtttggaccaaattccaatttttactgtttttcaagaaaatcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaa

SEQ ID NO: 144533 - DNA, 2015 bp, Homo sapiens
  Payload ID: 8560
  Gene Symbol: IAPP
  Gene Name: islet amyloid polypeptide
  ENST ID: ENST00000542023
  CDS Start-End: 102-341
agtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagacaggaatggataattccagttttgtcaagaaatatactcttggaacttagaggggcaaagccagaacatgaagcgggaaaaaaatcaaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaattta

SEQ ID NO: 144534 - DNA, 351 bp, Homo sapiens
  Payload ID: 8560
  Gene Symbol: IAPP
  Gene Name: islet amyloid polypeptide
  ENST ID: ENST00000537593
  CDS Start-End: 113-351
aagcttggactcttttcttgaagctttctttctatcagaagcatttgctgatattgctgacattgaaacattaaaagtgctggattattctttgcagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaa

SEQ ID NO: 144535 - DNA, 2309 bp, Homo sapiens
  Payload ID: 8561
  Gene Symbol: ICA1
  Gene Name: islet cell autoantigen 1, 69kDa
  Uniprot ID: Q05084
  ENST ID: ENST00000265577
  CDS Start-End: 193-1641
ctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgta

SEQ ID NO: 144536 - DNA, 946 bp, Homo sapiens
  Payload ID: 8561
  Gene Symbol: ICA1
  Gene Name: islet cell autoantigen 1, 69kDa
  ENST ID: ENST00000317367
  CDS Start-End: 179-946
ctcactctggcagctagaggttttgcctctggccagtgaccattcctttgagtagtgagctttctgttctttccagtaactgctggttataatataacttatcctctcatgcttttttcctgccccttctccccaaatcatcaacaatagaagaagaagaaaacatgtcaggacacaaatggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaag

SEQ ID NO: 144537 - DNA, 1415 bp, Homo sapiens
  Payload ID: 8561
  Gene Symbol: ICA1
  Gene Name: islet cell autoantigen 1, 69kDa
  ENST ID: ENST00000339809
  CDS Start-End: 168-941
taccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataa

SEQ ID NO: 144538 - DNA, 2133 bp, Homo sapiens
  Payload ID: 8561
  Gene Symbol: ICA1
  Gene Name: islet cell autoantigen 1, 69kDa
  Uniprot ID: Q05084
  ENST ID: ENST00000396675
  CDS Start-End: 68-1519
gctgcaggaagcagcaggagacgcccggcagccgggacggtcggggacgcctgaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttg

SEQ ID NO: 144539 - DNA, 1742 bp, Homo sapiens
  Payload ID: 8561
  Gene Symbol: ICA1
  Gene Name: islet cell autoantigen 1, 69kDa
  ENST ID: ENST00000401396
  CDS Start-End: 183-1598
ctcactctggcagctagaggttttgcctctggccagtgaccattcctttgagtagtgagctttctgttctttccagtaactgctggcaagttataatataacttatcctctcatgcttttttcctgccccttctccccaaatcatcaacaatagaagaagaagaaaacatgtcaggacacaaatggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatatt

SEQ ID NO: 144540 - DNA, 2458 bp, Homo sapiens
  Payload ID: 8561
  Gene Symbol: ICA1
  Gene Name: islet cell autoantigen 1, 69kDa
  Uniprot ID: Q05084
  ENST ID: ENST00000402384
  CDS Start-End: 268-1719
gctgcgctgcggtgcgcacgggctccgccggttgctattccggctggtggcggccgccgcaggaagggccggttcctgcgctccccccgcccctttccctcgccttcggctgacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgtatttctgaagcctcttgtgacattgttttttttttttttttaattaaacagaaaagatatttgacatgcaaa

SEQ ID NO: 144541 - DNA, 2440 bp, Homo sapiens
  Payload ID: 8561
  Gene Symbol: ICA1
  Gene Name: islet cell autoantigen 1, 69kDa
  Uniprot ID: Q05084
  ENST ID: ENST00000406470
  CDS Start-End: 253-1704
ttgtgacgcaaacgctatggccacgtggaacacctgccggagagcaggggcggggtcactctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgtatttctgaagcctcttgtgacattgttttttttttttttttaattaaacagaaaagatatttgacatgc

SEQ ID NO: 144542 - DNA, 1615 bp, Homo sapiens
  Payload ID: 8561
  Gene Symbol: ICA1
  Gene Name: islet cell autoantigen 1, 69kDa
  ENST ID: ENST00000407906
  CDS Start-End: 253-1305
ttgtgacgcaaacgctatggccacgtggaacacctgccggagagcaggggcggggtcactctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaaggtatggaagctagaggggccactagaaaatcttgagaaaagtaaagttttgtttatatcacaagcaaagtccattgcagaaagcatcattattccaggactcagaatgctgaagagagaactgtgcccccagcagagtctttttctttctttctttctttctttttttttttttttttttttttttactgcatcaggattcaatacaatgagaatctactgcaatccaaaagcgcgaattgaaccttgaaccttgagatacatgttcctgggagatgaattgtggtgaacttgagtctaatgattggtcctgctcctttaaaatacttgtttgacattgctaaaggggagattgtacaagtcccataaactcagttacttttaattattatattcaaatatcctcacttgagaaggtgtcctcctttcctctcttacttctgaaatgtatcattttattctgagagtattatccaacataaaattgaatttttctgtaagactacagcaatattttctaattgaaaaagcagtattaaactcaatgatttttcatctca

SEQ ID NO: 144543 - DNA, 530 bp, Homo sapiens
  Payload ID: 8561
  Gene Symbol: ICA1
  Gene Name: islet cell autoantigen 1, 69kDa
  ENST ID: ENST00000457755
  CDS Start-End: 157-414
gacgctgacgtcggatgagtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgttaatgaccatcccttctcagaaaatctaaccttgaccctgatggagctcacacttctttccactgccctctgatcttgtctcaagaagaaaacgaactgggaaaatttcttcgatccca

SEQ ID NO: 144544 - DNA, 551 bp, Homo sapiens
  Payload ID: 8561
  Gene Symbol: ICA1
  Gene Name: islet cell autoantigen 1, 69kDa
  ENST ID: ENST00000430867
  CDS Start-End: 150-551
gggggcgcgccgggcgggctgcaggaagcagcaggagacgcccggcagccgggacggtcggggacgcctggttataatataacttatcctctcatgcttttttcctgccccttctccccaaatcatcaacaatagaagaagaagaaaacatgtcaggacacaaatgttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgt

SEQ ID NO: 144545 - DNA, 604 bp, Homo sapiens
  Payload ID: 8561
  Gene Symbol: ICA1
  Gene Name: islet cell autoantigen 1, 69kDa
  ENST ID: ENST00000447326
  CDS Start-End: 119-604
ggatccgagcgggggataccccaggagatgggggtcgaggagagaccccggggagtagagagagagaaactcactccccgagtccccgaccctccccaagcaagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgc

SEQ ID NO: 144546 - DNA, 1539 bp, Homo sapiens
  Payload ID: 8561
  Gene Symbol: ICA1
  Gene Name: islet cell autoantigen 1, 69kDa
  Uniprot ID: Q05084
  ENST ID: ENST00000422063
  CDS Start-End: 1-1539
atgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaatatttacagaatatttgcctcgagatgaaagcaaattcagatattaagatgctacagaaagggaaagaaggccagcaaattggcatattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatga

SEQ ID NO: 144547 - DNA, 539 bp, Homo sapiens
  Payload ID: 8561
  Gene Symbol: ICA1
  Gene Name: islet cell autoantigen 1, 69kDa
  ENST ID: ENST00000446305
  CDS Start-End: 328-539
aagcagtaggcactacgcacagcacagagggaaccctggggtgtacgctgtggctcccacctgtccgccaggtcattgtgacgcaaacgctatggccacgtggaacacctgccggagagcaggggcggggtcactctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctgga

SEQ ID NO: 144548 - DNA, 1956 bp, Homo sapiens
  Payload ID: 8561
  Gene Symbol: ICA1
  Gene Name: islet cell autoantigen 1, 69kDa
  ENST ID: ENST00000455539
  CDS Start-End: 140-403
agtgatccggagggacgctccgaccgcggccgggaggctcctgggggccggggctccgaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgttcattttaggaggccaaggcaggaggatcacttggagccaggagtttgagaccagcctgggcaacaaagtgagacccccatctctacaaaaaataaaaacacttaaaaattatccgggtaccgtgcatgtgcagtcccagctactcaggaggctgaggcaggaggatcacagtgacctataatgagccgttgtgctccagcctgggcgacagaagtcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataa

SEQ ID NO: 144549 - DNA, 3457 bp, Homo sapiens
  Payload ID: 8562
  Gene Symbol: ICA1L
  Gene Name: islet cell autoantigen 1,69kDa-like
  Uniprot ID: Q8NDH6
  ENST ID: ENST00000358299
  CDS Start-End: 375-1823
aatgttctgaccggtttggtgtttgtcatttcactttattaagtaaagaggaaatcgggaaaggaggaatagagagggtccccgagttcattcaagagcagaccgagagatgctccgatcccgagtcgggccggtggcggggtcaggccggcgcccgaggggggcgaacgcggacgccaggtcgcgcggtttaaatctcccgcctcccgcagcgggagcctgacacctccacgcactggtgcggaggggcactggctgccggagggccgggagtcggcgcggggctcgcgggcggtggccggaacgggtgccgggacggatcaccgtacggccgaacgcgacccgaggaggcggaagagcggcgccgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaaccccgtctctactaaaaatacaaaaaattagccaggcgtggtggcacgtgcctgtagtcccagctactccggaggctgaggcaggagaatggcgtgaacccgggaggcggagcttgcagtgagctgagatggcgccactgcactccagcctaggcaacagagcaagactccgtctc

SEQ ID NO: 144550 - DNA, 5173 bp, Homo sapiens
  Payload ID: 8562
  Gene Symbol: ICA1L
  Gene Name: islet cell autoantigen 1,69kDa-like
  Uniprot ID: Q8NDH6
  ENST ID: ENST00000392237
  CDS Start-End: 159-1607
cgaggaggcggaagagcggcgccggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaaccccgtctctactaaaaatacaaaaaattagccaggcgtggtggcacgtgcctgtagtcccagctactccggaggctgaggcaggagaatggcgtgaacccgggaggcggagcttgcagtgagctgagatggcgccactgcactccagcctaggcaacagagcaagactccgtctcaaaaaaaaaaaaaaaaaaaaaagacattttaactaagttattcacagtagcttccatgtgctcttagttctattctaaacaggcttatttagaaaaggattgcttgtaatgtttgtcatggtacatagaaaacattggaccagagtaggtaaaatgcagtccatgtcccatccatagccatctacaatagtaactgcccacaggctctccagaaaactactacaatggccaagtacagtataggctggaaagaccttatctgaaggtcagaaacattgactcagaaaaaaggtatgaagtctttccataaaatcttttcacaatattactcctatttcttttagattttaatgagccattacttatctcttcagaagacttaagtcttcctttatactcagtgaaatttcccagaatgtaatactgtcactgttctgccaagttccaatcaccaagatcatgattacgaatcccaatctgaattctatacccatggtgactctgatgctctcaacttttgagtgcctcaaaaaatgctaaaactttggctgggcatggtggctcacgcctgtaatcccagcactttgggaggccatggcgggtggaacatttgagggcatgagttcgagaccagcctggccaacatggtgaaaccctgtctctactaaaaatacaaaaattagccaggtgtggaggtacatgcctgtaatcccagctactcaggaggctgaggcagaagaattgcttgaacccaggcggcagaggttgcagtgagtcgagattgcaccactacactccagcctgggcaacagagagcgactctctcaaaaaaaaaaaaaaaaaaaaaaaaaaaagctaactttatgtcttgagagtttgtaccatttttctttgtagtggtcaccttgctaatgcattagttctgagatatttatctccctcacatgtgtgcaaggaagtccctgttatcgaatacagatactttaacaagcagacaaagcagaaacccaaagtccatactaggaacaccctaaattttccaaaagcaaaagttctcccgaaatggagacatacaagggacttttattattctgttactagtttctataacatttcttctttcaacagagtatatgtttcccatttaacccagagcaacattaacttccttagcaagtccagttctaacttccaacaagtccaaccactgtttttgaagagcatatcagtaactatattaagatgaaggtaaccacattcgtattttctcaagattagttatttgaagctcagcagtttttgtggtcagaaagaaattttgctctattaaaccaatactgctaatataaaaaaccaccacactgaagaaacgagggaaaggacgggataagcacagaacagagaatgactggttgctttttgtctcaatctagataatccattcaataagaagtaaattaattatccttaaccaatggtaggctgagaacaaccctcaaaatagatattttttatgttaaatggggagaaatatctatactttatgttatactggataaaaatgtgttttaagtctaaaaaaaaccagacgagctaaactttgcctagtgtgtctacaaccattttttaggagacgcaggaataccagggcataataagatcagattggtgtaattttgtatgtttttgaaatccttcattaattgtagaaccttgatatgattagaaacaaactgtatttcaacaaacaggtttcagtatttgcacactgaaaaagtgttttgtattttaactataaatatttcacgtatctgtatagaccatctagaaatgtagaggtcttacagcattagaacgaaggaagtttacatgtgctctatctatttttctgagcctcttttaataaagattgcaagaaggcataaaacaaga

SEQ ID NO: 144551 - DNA, 595 bp, Homo sapiens
  Payload ID: 8562
  Gene Symbol: ICA1L
  Gene Name: islet cell autoantigen 1,69kDa-like
  ENST ID: ENST00000412210
  CDS Start-End: 238-595
aacgcgacccgaggaggcggaagagcggcgccggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaa

SEQ ID NO: 144552 - DNA, 562 bp, Homo sapiens
  Payload ID: 8562
  Gene Symbol: ICA1L
  Gene Name: islet cell autoantigen 1,69kDa-like
  ENST ID: ENST00000416760
  CDS Start-End: 268-562
gacccgaggaggcggaagagcggcgccgggaagcctctggtgattcagttacctctgactggcttgttgaatttaattttagtgctcggttatgaagattatttggctctcacaattttttgagatggggtctcactgtgtccctctggctgtagtgcagtggcacattcatagctcactacagcctcaaactcctgggctcaagtgatcctcccacttcagcatcccaggtagctgggactacaggcatatgccacaattcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatg

SEQ ID NO: 144553 - DNA, 689 bp, Homo sapiens
  Payload ID: 8562
  Gene Symbol: ICA1L
  Gene Name: islet cell autoantigen 1,69kDa-like
  ENST ID: ENST00000432273
  CDS Start-End: 393-689
agatacctgatgctctaaggaagacggagaggggaaagcggggagtccatcctggcagctcacccgcgatgctggggcgttgccagtagagggggtggaatcatttttcgtgtaatagatgatcttgatgcacacagcataaaagctgttataaactatgggtctctgtaaaatagattgttgggaaggtaacatttttccatggttttgatttttcccaaaagtatttatgtattgatttatttggttctgactcaggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgca

SEQ ID NO: 144554 - DNA, 575 bp, Homo sapiens
  Payload ID: 8562
  Gene Symbol: ICA1L
  Gene Name: islet cell autoantigen 1,69kDa-like
  ENST ID: ENST00000437978
  CDS Start-End: 261-443
ggcggtggaggtcgctcctaatagaggcggcggcggatcacccgaacagccttcaggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaagg

SEQ ID NO: 144555 - DNA, 2481 bp, Homo sapiens
  Payload ID: 8562
  Gene Symbol: ICA1L
  Gene Name: islet cell autoantigen 1,69kDa-like
  ENST ID: ENST00000438804
  CDS Start-End: 470-1789
ctcggttctctgggggaccccggccgctgcctgcggccttcttccaggcgaggccctgctcggggttcttccggcctccccccaggcaaaacccgcaaggagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcaggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaataatgctgcaaaaaaaaaaaaatcatgcatgtacttcttccttcagctaaattatttccttaagaaaaattgctaggaatgggatcactgagtccaaggactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgagga

SEQ ID NO: 144556 - DNA, 572 bp, Homo sapiens
  Payload ID: 8562
  Gene Symbol: ICA1L
  Gene Name: islet cell autoantigen 1,69kDa-like
  ENST ID: ENST00000420558
  CDS Start-End: 240-572
aactatgggtctctgtaaaatagattgttgggaaggtaacatttttccatggttttgatttttcccaaaagtatttatgtattgatttatttggttctgactcaggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttgcaaaagatctacctgtagattcattggaaggagaagattttgagaaggaattctcatttctgaacaacctcctaagttctggttcttcaagtact

SEQ ID NO: 144557 - DNA, 879 bp, Homo sapiens
  Payload ID: 8562
  Gene Symbol: ICA1L
  Gene Name: islet cell autoantigen 1,69kDa-like
  Uniprot ID: Q8NDH6
  ENST ID: ENST00000425178
  CDS Start-End: 226-789
ggactacaggcgcccgccaccatgcccggctaatttttttttgtatttttagtagagacagggtttcaccgtgttagccaggatggtctcgatctcatgaccgcgtgatccgctcgcctcagcctcccaaagttgtggaattacaggcgtgagccaccgtgcccagcctattattgagaatttttaaaagaagtttaattttagtctgttcattgtagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtatgaaaacgtatccctttccttttcttggtgtatgaaatatgaaactgccacagaataattaagataataaaatttcagatgttttttggtaaa

SEQ ID NO: 144558 - DNA, 526 bp, Homo sapiens
  Payload ID: 8562
  Gene Symbol: ICA1L
  Gene Name: islet cell autoantigen 1,69kDa-like
  ENST ID: ENST00000441547
  CDS Start-End: 168-526
tagataaggaaataaaacatttccaataaagctgaagtctcatcccacccatccgttatcaggctggagtgcagtggcatgatcgtagtttactgtaaccttgaactcctgggctcaagcaatcttcccccatcagcctcctgagtagctaggactacagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaag

SEQ ID NO: 144559 - DNA, 559 bp, Homo sapiens
  Payload ID: 8562
  Gene Symbol: ICA1L
  Gene Name: islet cell autoantigen 1,69kDa-like
  ENST ID: ENST00000457524
  CDS Start-End: 260-559
gggaccccggccgctgcctgcggccttcttccaggcgaggccctgctcggggttcttccggcctccccccaggcaaaacccgcaaggagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaact

SEQ ID NO: 144560 - DNA, 515 bp, Homo sapiens
  Payload ID: 8562
  Gene Symbol: ICA1L
  Gene Name: islet cell autoantigen 1,69kDa-like
  ENST ID: ENST00000435143
  CDS Start-End: 114-515
tcgtttgggtgatttccctcggcggtggaggtcgctcctaatagaggcggcggcggatcacccgaacagccttcaggtgcttccctgctgacctctttttaacgtgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagta

SEQ ID NO: 144561 - DNA, 556 bp, Homo sapiens
  Payload ID: 8562
  Gene Symbol: ICA1L
  Gene Name: islet cell autoantigen 1,69kDa-like
  ENST ID: ENST00000411681
  CDS Start-End: 322-556
agaatgcacgggcccgcgaggggctccgcgcacagatcctgctccttaggccggcaacccgaccccacggcacagatatggctcctggaaacgcgcgtcagctggtcaggtgcccaggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatg

SEQ ID NO: 144562 - DNA, 566 bp, Homo sapiens
  Payload ID: 8562
  Gene Symbol: ICA1L
  Gene Name: islet cell autoantigen 1,69kDa-like
  ENST ID: ENST00000419460
  CDS Start-End: 195-566
actggctgccggagggccgggagtcggcgcggggctcgcgggcggtggccggaacgggtgccgggacggatcaccgtacggccgaacgcgacccgaggaggcggaagagcggcgccgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgt

SEQ ID NO: 144563 - DNA, 576 bp, Homo sapiens
  Payload ID: 8562
  Gene Symbol: ICA1L
  Gene Name: islet cell autoantigen 1,69kDa-like
  ENST ID: ENST00000450143
  CDS Start-End: 125-576
agaatgcacgggcccgcgaggggctccgcgcacagatcctgctccttaggccggcaacccgaccccacggcacagatatggctcctggaaacgcgcgtcagctggtcaggtgcccagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcg

SEQ ID NO: 144564 - DNA, 602 bp, Homo sapiens
  Payload ID: 8562
  Gene Symbol: ICA1L
  Gene Name: islet cell autoantigen 1,69kDa-like
  ENST ID: ENST00000418208
  CDS Start-End: 267-500
gatgcacacagcataaaagctgttataaactatgggtctctgtaaaatagattgttgggaaggtaacatttttccatggttttgatttttcccaaaagtatttatgtattgatttatttggttctgactcaggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacacctt

SEQ ID NO: 144565 - DNA, 799 bp, Homo sapiens
  Payload ID: 8562
  Gene Symbol: ICA1L
  Gene Name: islet cell autoantigen 1,69kDa-like
  ENST ID: ENST00000421334
  CDS Start-End: 673-799
cttgctggcctcctcggttctctgggggaccccggccgctgcctgcggccttcttccaggcgaggccctgctcggggttcttccggcctccccccaggcaaaacccgcaaggagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcaggtgcttccctgctgacctctttttaacgtggtgcttatttttatttcgctattattttgtaatgggaatgtcttccttagaaactaattggcaaccgatggataaaaacaaaacatagtaaatgtgcagtttgagctgaactgcagaatgcacgggcccgcgaggggctccgcgcacagatcctgctccttaggccggcaacccgaccccacggcacagatatggctcctggaaacgcgcgtcagctggtcaggtgcccaggcgacgtactgtaagacgatattactttaatcatcttcacatcagtatttatggaatagccacaggtgcctcatcctttagtaggagttaattatacatttactggccgagtaaacatctccgaatgtcactccatggattcctttgggcaacccagaccagaagataatcagtcagtagtcagaagaatgcaaaagaaatactggaaaactaaacaggtctttatcaaagcaacaggaaaaaaagaggatgagcacttgg

SEQ ID NO: 144566 - DNA, 714 bp, Homo sapiens
  Payload ID: 8562
  Gene Symbol: ICA1L
  Gene Name: islet cell autoantigen 1,69kDa-like
  ENST ID: ENST00000454326
  CDS Start-End: 425-714
cggggagtccatcctggcagctcacccgcgatgctggggcgttgccagtagagggggtggaatcatttttcgtgtaatagatgatcttgatgcacacagcataaaagctgttataaactatgggtctctgtaaaatagattgttgggaaggtaacatttttccatggttttgatttttcccaaaagtatttatgtattgatttatttggttctgactcaggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacg

SEQ ID NO: 144567 - DNA, 8151 bp, Homo sapiens
  Payload ID: 8562
  Gene Symbol: ICA1L
  Gene Name: islet cell autoantigen 1,69kDa-like
  Uniprot ID: Q8NDH6
  ENST ID: ENST00000617388
  CDS Start-End: 320-1768
ggggccttgctggcctcctcggttctctgggggaccccggccgctgcctgcggccttcttccaggcgaggccctgctcggggttcttccggcctccccccaggcaaaacccgcaaggagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcaggtgcttccctgctgacctctttttaacgtgtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactttctggcagacatacagaaagctctgtgtgatcaataagggagtgtctcatttttctacttccctctttctgtgggtgacatgatctgaggttctatttgattactaagcaaaatctgttacccctacagggtttagaacctaagtattagagaggaaggctatttaatggaagttagtgtaagctgataaaaacgtagctaccgtacacacacatcaatcactcaatttcctgtccttttaaattgcccaccctttaattttgaagcaatttcccaagtgtgtgtttgttttatatttgtcatccagtccattgcatttccataagaagacattttgactggctgggtgcggtggctcacgcttgtaatcccagcactttgggaggctgaggcaggcggatcacgaggtcaggagatggagaccatcctggctaacatggtgaaaccccgtctctactaaaaatacaaaaaattagccaggcgtggtggcacgtgcctgtagtcccagctactccggaggctgaggcaggagaatggcgtgaacccgggaggcggagcttgcagtgagctgagatggcgccactgcactccagcctaggcaacagagcaagactccgtctcaaaaaaaaaaaaaaaaaaaaaagacattttaactaagttattcacagtagcttccatgtgctcttagttctattctaaacaggcttatttagaaaaggattgcttgtaatgtttgtcatggtacatagaaaacattggaccagagtaggtaaaatgcagtccatgtcccatccatagccatctacaatagtaactgcccacaggctctccagaaaactactacaatggccaagtacagtataggctggaaagaccttatctgaaggtcagaaacattgactcagaaaaaaggtatgaagtctttccataaaatcttttcacaatattactcctatttcttttagattttaatgagccattacttatctcttcagaagacttaagtcttcctttatactcagtgaaatttcccagaatgtaatactgtcactgttctgccaagttccaatcaccaagatcatgattacgaatcccaatctgaattctatacccatggtgactctgatgctctcaacttttgagtgcctcaaaaaatgctaaaactttggctgggcatggtggctcacgcctgtaatcccagcactttgggaggccatggcgggtggaacatttgagggcatgagttcgagaccagcctggccaacatggtgaaaccctgtctctactaaaaatacaaaaattagccaggtgtggaggtacatgcctgtaatcccagctactcaggaggctgaggcagaagaattgcttgaacccaggcggcagaggttgcagtgagtcgagattgcaccactacactccagcctgggcaacagagagcgactctctcaaaaaaaaaaaaaaaaaaaaaaaaaaaagctaactttatgtcttgagagtttgtaccatttttctttgtagtggtcaccttgctaatgcattagttctgagatatttatctccctcacatgtgtgcaaggaagtccctgttatcgaatacagatactttaacaagcagacaaagcagaaacccaaagtccatactaggaacaccctaaattttccaaaagcaaaagttctcccgaaatggagacatacaagggacttttattattctgttactagtttctataacatttcttctttcaacagagtatatgtttcccatttaacccagagcaacattaacttccttagcaagtccagttctaacttccaacaagtccaaccactgtttttgaagagcatatcagtaactatattaagatgaaggtaaccacattcgtattttctcaagattagttatttgaagctcagcagtttttgtggtcagaaagaaattttgctctattaaaccaatactgctaatataaaaaaccaccacactgaagaaacgagggaaaggacgggataagcacagaacagagaatgactggttgctttttgtctcaatctagataatccattcaataagaagtaaattaattatccttaaccaatggtaggctgagaacaaccctcaaaatagatattttttatgttaaatggggagaaatatctatactttatgttatactggataaaaatgtgttttaagtctaaaaaaaaccagacgagctaaactttgcctagtgtgtctacaaccattttttaggagacgcaggaataccagggcataataagatcagattggtgtaattttgtatgtttttgaaatccttcattaattgtagaaccttgatatgattagaaacaaactgtatttcaacaaacaggtttcagtatttgcacactgaaaaagtgttttgtattttaactataaatatttcacgtatctgtatagaccatctagaaatgtagaggtcttacagcattagaacgaaggaagtttacatgtgctctatctatttttctgagcctcttttaataaagattgcaagaaggcataaaacaagagtttgtttcctgaagtttttagtacaattattgttttcctattcaaaaacttgggttttacctcaagatcatagtattaggaaagtacattgagttgatacggacatgggagaacgaaaataaaaccagggcaattaatatccttgtaaggccaggcgcggtagctcacgcctatataacagcactttgggaggccaaggcaggcagatcacttgaagttgggagtttgagaccaccctggccaacatggtgaaaccccatctctatgaaaaatataaaaattagctgggcatggtggcagatgcctgtaatcccagctacttgggaggctgaggcaggagaatcgcttgaacccgggaggtggaggttgcagtgagctgagatcaggccatgcactccagcctgggtgacagagtgagactccgtctcaaaagaaaatccttgtgagatgaattcgttcttatttcatatacaaggggactatgtaagatatgggaaataatataatgtacgttatttatgtaaatactttcagtaacaaaaactaacaaatatcaaaaatctgagcctagacacaaacaattaaatataagccatagtatgtaacctgacttattgaaggcaggaataaaaagaagagagccagaattgattcagttatttttgtcttccatagtgttggcagggccctgcatttctctaccttgagcaatgaagcagtcccagaattttggaatatagaaattaggaaggaaaaacgaactttaaaatattaatttagtagaactgaaagtaatgcatttcatgcaacagtaaagtgcttaaacatggcaaagaaaactaagggacaagataagaaaaatggttggtaaagatgggtcacatccagaagcccaacataagctatttttccatctttttctgtaccatttaaaagactactaaagagttcaaaacaaactgtccttggcatttaaagtcaaaacatggttcttcactcagtggtgtaaattaactactcattggccaaagagtaaatacaaaaaggagatgaagttctgactggtgttgtgggtgagattttgcagtgtatgtttttacatttgtagtgtacgttttaaacttccggttttcttgctgcctcaacatctccacaaacaggctgtgagcacctggcccagtgtgatatgggtggcccctgccacaagtttcccttgctaccttgcccatgacctagtaacatttaaatgcaccagtgaaattctctttttcttgtgtgcttctccctgacccaaaggctcctgcccatgtcttaggcctctccgctccccacctgcttggctgagccccctcccatgtgaccccctctcagcatgcagtgactggtctctctaggacctgtgagtatattacaactttttttcctgtgtctctcctgtgatatctcttgtggctaaacctcactgaccataacctaaaaaaacacatacaaaaaacatgaaagaaaaagttgtttcttgagctggcctggacgaacggggagccaggggctcgaccctggctgttggaggcgcagtgaggcctggtctccggctgccagaccacgctgagcggagcgcgcggcaggctcgcctcagcgctgcggggaacgcgcgcgccgccgtccgcggtcgcccgtaggtgcctgcacgcgtcggggtcacggcctttggccgacaggagcgagaagactcaggagccgccccgcgccttcgatccggcgctgctggagttcctggtgtgcccgctctccaagaagccgctcagatatgaagcatcaacaaatgaattgattaatgaagagttgagaatagcttatccaatcattgatgggattcctaatattatcatattaggcagctaggatgacacatcaaagaagcaagaagtggagcagcgctagttcataatttaaaaaaataaaacagccaactcttcttagtaccatataccttttaaaacacagtggcaagtaataagcggaagagaagaatctttctgtctctttctacgttgactgttcttattccactggtttatttagcaggactgttccactcagcctctgtagaagaaaacttcccacagggctgcacttgcacagctagcctttgcttttacagcctgctcttgcctattaccataccggtgtatgtattcttccacctttggacctggatggttattaaactcttcatgcataactgatgcaactagagtcaatatgctgtatatattaatgatagctcttgggcatctatctctgaaagctcaaatggatggaatttagtttgtgggaaagaggctttgctttgagcatatcaggcttaggactgtggacggcttaagttgcagacgcttcttttattgtactcttgttctgcccgtgttttttgaaggctctgacataactgctttatcagaagaaacattttgacagtgtcttgttggagataaacatccctaattgacatgtgatgactacttcttattccattcatctaagagtcattgaaattttgttttctttgtttgtttagcttcaaggtctttggtagtcacatgttagggatgactgaaataattccaaaggagtgatgttggaatagtccctctaagggaaagaaatgcatttgaacgaatgtgatataaaaccacataatcaaatagaaatttcatgtacttacaaaaatttagtttgtaaaattaccttcatttctttgacattaaatgcttatattagcaataaagatgttgacactttctcataaaaaattt

SEQ ID NO: 144568 - DNA, 837 bp, Homo sapiens
  Payload ID: 8563
  Gene Symbol: IAH1
  Gene Name: isoamyl acetate-hydrolyzing esterase 1 homolog
  ENST ID: ENST00000351760
  CDS Start-End: 1-226
cgaggccgcgggctgcgggagtgccctgctctggcctcgcttgttgctcttcggggactccatcacccagttttccttccagcagggtggatggggagcatcgctggctgacaggctggtcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttca

SEQ ID NO: 144569 - DNA, 1266 bp, Homo sapiens
  Payload ID: 8563
  Gene Symbol: IAH1
  Gene Name: isoamyl acetate-hydrolyzing esterase 1 homolog
  Uniprot ID: Q2TAA2
  ENST ID: ENST00000497473
  CDS Start-End: 38-784
tggctggcggccccgccccgccccgcccggctgctccatggcgctgtgcgaggccgcgggctgcgggagtgccctgctctggcctcgcttgttgctcttcggggactccatcacccagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggg

SEQ ID NO: 144570 - DNA, 670 bp, Homo sapiens
  Payload ID: 8563
  Gene Symbol: IAH1
  Gene Name: isoamyl acetate-hydrolyzing esterase 1 homolog
  ENST ID: ENST00000496603
  CDS Start-End: 448-670
gaatgagggccctaggttggatcttagttgtaaagctcccccaggtgatccaagcgagcttgggacgagcaacctaaagaaagtcatgctctacgcccatcgccccgccccagggagcggggtcggcctctgcgccggcgcccctggcccttctgttactcatctacagctccgtgatttcaaggcatccttcccacccgttcgtttttagctcggctgccgaacttcattgcacagttgagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagcc

SEQ ID NO: 144571 - DNA, 863 bp, Homo sapiens
  Payload ID: 8563
  Gene Symbol: IAH1
  Gene Name: isoamyl acetate-hydrolyzing esterase 1 homolog
  Uniprot ID: Q2TAA2
  ENST ID: ENST00000482918
  CDS Start-End: 341-748
catctacagctccgtgatttcaaggcatccttcccacccgttcgtttttagctcggctgccgaacttcattgcacagttgagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaa

SEQ ID NO: 144572 - DNA, 2137 bp, Homo sapiens
  Payload ID: 8563
  Gene Symbol: IAH1
  Gene Name: isoamyl acetate-hydrolyzing esterase 1 homolog
  Uniprot ID: Q2TAA2
  ENST ID: ENST00000470914
  CDS Start-End: 317-724
cggccccgccccgccccgcccggctgctccatggcgctgtgcgaggccgcgggctgcgggagtgccctgctctggcctcgcttgttgctcttcggggactccatcacccagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaatatctgcttgtgggtcaataaaaagggtttctgaagtatcaagtcttgtggggacagcccccaaccctaagggcaggtagtattctatctcctggctggctcatcacattcaaaacaacctgttttttttgttgttgttgttgttaagaaatatctcaccctcttattcaatagtgtttgaaaacaggcaatctttgtattttaaatattctaggtttgtagatagtgaattttttttttttttttttttttttgaggcagagtctcactctgtcacccaggctggagtgtagtggcgcaacctcagcctctccaagtgctgggattacaggcatgagccaccactcccagccaatagtgaattttctaagagcatgtatccctatcagtaacagggatacatgaagatacttataaaatacagaaaaactgcccagcaaatcagggccctaaacagttggtagattccataaattcaactggctaccatgtatagccctcactgtaaggtaggtggttaggtttctagagagcattagtcttagaattatgaagagccatattaacccaaatgatttctaaatttagatatatattttccctgctacataaaaactctgggtaataactagaaatagacccacaatttagagacaatgtatactagatttatctcctttgtttttagttgaaggcaaaaaaaaaaaaaaaaa

SEQ ID NO: 144573 - DNA, 818 bp, Homo sapiens
  Payload ID: 8563
  Gene Symbol: IAH1
  Gene Name: isoamyl acetate-hydrolyzing esterase 1 homolog
  ENST ID: ENST00000492223
  CDS Start-End: 29-151
gccccgccccgccccgcccggctgctccatggcgctgtgcgaggccgcgggctgcgggagtgccctgctctggcctcgcttgttgctcttcggggactccatcacccaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatt

SEQ ID NO: 144574 - DNA, 1137 bp, Homo sapiens
  Payload ID: 8563
  Gene Symbol: IAH1
  Gene Name: isoamyl acetate-hydrolyzing esterase 1 homolog
  ENST ID: ENST00000481367
  CDS Start-End: 1-686
gtgcgaggccgcgggctgcgggagtgccctgctctggcctcgcttgttgctcttcggggactccatcacccagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagagcatcgacatagggcacacagcggccagaaaggtccctgcagcacaccttgcaggagttgtcagtttctggaacagagaacacgcattgacagctggattgttctgagacctgcctctcctcctgcctcctctttcctccctgaccatgctcccaaagagagacagcgttttgccatgttgaccaagctgctctcaaactcctgacctcaagtgatctgcccacctcggcctcccaaagtgatgggattacaggtgtgagtcaccacacctggctctctgtctattttgaaagcaagagaactccctcatcgactcccatggtttaagtggggtgggaagcagagtccagccagtccctgaccagtccatgaggatgccctcaaaccca

SEQ ID NO: 144575 - DNA, 1011 bp, Homo sapiens
  Payload ID: 8563
  Gene Symbol: IAH1
  Gene Name: isoamyl acetate-hydrolyzing esterase 1 homolog
  ENST ID: ENST00000481688
  CDS Start-End: 355-834
gagagcccgggctccaggcacagacgcgaggggacccggccgcgctgcccgccccgcgccgcctcccacccgggtcgagatgcgcggtcttcccctcagcgccctcctgggcagcggcctttcccctccgggtccgggttagcggccgcgggcgaccgcgcgctgtgtcccaggaggccccgcggccagctccgggcagaggcgccaggagctctctcgccccattccctgcgggcacaggtggggccgttaggggttgaccttggaagtaaaacgccttcaggaattaggtagaaaaggaccatccgttcatccaagatcatctcacctcccatgaagggaacggtcttctaaatgcagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctggga

SEQ ID NO: 144576 - DNA, 478 bp, Homo sapiens
  Payload ID: 8563
  Gene Symbol: IAH1
  Gene Name: isoamyl acetate-hydrolyzing esterase 1 homolog
  ENST ID: ENST00000495797
  CDS Start-End: 337-478
agaggcgccaggagctctctcgccccattccctgcgggcacaggtggggccgttaggggttgaccttggaagtaaaacgccttcaggaattaggtagaaaaggaccatccgttcatccaagatcatctcacctcccatgaagggaacggtcttctaaatgcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtg

SEQ ID NO: 144577 - DNA, 1940 bp, Homo sapiens
  Payload ID: 8564
  Gene Symbol: ISOC1
  Gene Name: isochorismatase domain containing 1
  Uniprot ID: Q96CN7
  ENST ID: ENST00000173527
  CDS Start-End: 17-913
agacgctcgggggaacatggcggctgcggagccggcggtccttgcgctccccaacagcggcgccgggggcgcgggggcgccgtcgggcacagtcccggtgctcttctgtttctcagtcttcgcgcgaccctcgtcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggcttcgcggtgagcgagcgctgcaaggtgcgcctcgtgccgttgcagatccagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcagagattcccggagtcaggagtgttgtattatttggagtagaaactcatgtgtgcatccaacaaactgccctggagctagttggccgaggagtcgaggttcacattgttgctgatgccacctcatcaagaagcatgatggacaggatgtttgccctcgagcgtctcgctcgaaccgggatcatagtgaccacgagtgaggctgttctgcttcagctggtagctgataaggaccatccaaaattcaaggaaattcagaatctaattaaggcgagtgctccagagtcgggtctgctttccaaagtataggacatttgaagaactggtatgctactcactggtgaaggacagtcaggtgaaggactgtaagcccacacaagctcttcttatctctactagaattaaaatgttaagtcaaaaacggctccttttttgcgcctcctagtgaaacttaaccagctagaccatttgagtaccagcatttagttacaaacgtcaaaggcttccggtgctgcttaccttccttttttgttaatgtgcttttatttattaaaaaaaattacaatgaagatgcctgttttgtctctactgtgtactctgatcgtatctttccaaagtgcagactcttgtgaagttttcttaaattgttcactttaaagaaaatgacgtaccaacaatgatttggcttttatattactgtaagatgttataatgttaatgtggatgtagtgcttttactttacagattgattggaataagattattgcatatgaatttacccacaggactctgaatcatgttacccactcccctcacaatgttgtccacttagtgagttgcattgatctatccgtaccaaatgatgttgaataattacatatctttcttgactatactgatttcttattttggtcactattactaaatctctgttaatattctctcttttaactgaaaagggatgggatagaagggtttgcaatgccatattattggtggagggctgttttaacatctttgaagtatggcttgctgaatatctttaccaacatcttgaatatatattctagtgtccacaagatttagcaaaaagataaagcttgggtggaatatcattttaaaatgttcatgttctgttctatattttcttcacctactctccaaatattgtaatgcaaaaagtctcagtaatgatttggtagtattaattttgtggtcattgtttctcttcgataaatttattttcattaaatacttgttagagggttttgaaatgtttttcaaatatgtgaaatgtgaaactgctgtcttttatattaaagtaattaaagaaaa

SEQ ID NO: 144578 - DNA, 581 bp, Homo sapiens
  Payload ID: 8564
  Gene Symbol: ISOC1
  Gene Name: isochorismatase domain containing 1
  ENST ID: ENST00000514194
  CDS Start-End: 17-581
agacgctcgggggaacatggcggctgcggagccggcggtccttgcgctccccaacagcggcgccgggggcgcgggggcgccgtcgggcacagtcccggtgctcttctgtttctcagtcttcgcgcgaccctcgtcggtgccacacggggcgggctacgagctgctcatccagaagttcctcagcctgtacggcgaccagatcgacatgcaccgcaaattcgtggtgcagctgttcgccgaggagtggggccagtacgtggacttgcccaagggcttcgcggtgagcgagcgctgcaagctcactaccctgggaaatcttacaccttcaagcactgtgtttttctgctgtgatatgcaggaaaggttcagaccagccatcaagtattttggggatattattagcgtgggacagagattgttgcaaggggcccggattttaggaattcctgttattgtaacagaacaataccctaaaggtcttgggagcacggttcaagaaattgatttaacaggtgtaaaactggtacttccaaagaccaagttttcaatggtattaccagaagtagaagcggcattagcag

SEQ ID NO: 144579 - DNA, 1122 bp, Homo sapiens
  Payload ID: 8565
  Gene Symbol: ISOC2
  Gene Name: isochorismatase domain containing 2
  Uniprot ID: Q96AB3
  ENST ID: ENST00000085068
  CDS Start-End: 138-803
cctaacgaaacggtaaccagccctgggaagcccgcaagaggcctcagcggtggccgtccgagagccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttggacccccgttcttatccggggttggccctgacctctctctacccacagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 144580 - DNA, 998 bp, Homo sapiens
  Payload ID: 8565
  Gene Symbol: ISOC2
  Gene Name: isochorismatase domain containing 2
  Uniprot ID: Q96AB3
  ENST ID: ENST00000425675
  CDS Start-End: 62-679
ggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttgaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 144581 - DNA, 1566 bp, Homo sapiens
  Payload ID: 8565
  Gene Symbol: ISOC2
  Gene Name: isochorismatase domain containing 2
  Uniprot ID: Q96AB3
  ENST ID: ENST00000438389
  CDS Start-End: 836-1243
ctttctctcaacctccatttccaagcacagagtctaaattattctaaacaccacccgaggaggcaggtgctgtacagatggggaaactgaggcagcacagagcgcaaaggacaggggggcgtcaaattcctcacttgatcgctccctcagccagccccttcctggaaagtgcttgggtatctttgtaagcctccgtttcttgagagagggccaggtttcgaaccgcagacatgcctctactctaggtaagacccctctctctctctcccggcctcggcggtctgctctgtgcaatggggccggccgagacgccctctctccagccagagtctgagccttcggagaccaccgcgcgactccgccccgtcggccgccactcacgccctctacggctctccattggcagaacgacctgctgccccgcccccacggcgcctttgcgagctaatcattttcttgagactgacagccttgccggcaccgccccccctggggcgggagcaaagcagctgcatatgcggattggttgagaggcagggggcggggtgagttggtgagcgccgattgcgggcagaggcagtggcacatgcggattggccggagagagcggcgaggcagagcatgatgagtgtcgattggacggctgggcccaagtgggcggaaaacggacggtgcagggggtgggccacgtgtccagccctaacgaaacggtaaccagccctgggaagcccgcaagaggcctcagcggtggccgtccgagagccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgcccccttgtggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggctgtg

SEQ ID NO: 144582 - DNA, 854 bp, Homo sapiens
  Payload ID: 8565
  Gene Symbol: ISOC2
  Gene Name: isochorismatase domain containing 2
  ENST ID: ENST00000587226
  CDS Start-End: 319-854
agagggtttgtgtatccatcattttgagaaatgcagctgctcggctgtccctaggagttgttgtgacccacactcctaccaggccagaggggagttcctgggtgctccacatgcctgtcctaggcttttggacatgctggcccccagatctgcccctccatggctcctcactgccctcagcagagagactccagggcccttgtgacccacctgtcagctctccagctcctggttccctcagaaccatcccttggggcccgggtgtccaggtcccgcctcctgcacaggggaggaagagttagcacatgagtggccaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttgaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaagga

SEQ ID NO: 144583 - DNA, 763 bp, Homo sapiens
  Payload ID: 8565
  Gene Symbol: ISOC2
  Gene Name: isochorismatase domain containing 2
  ENST ID: ENST00000589080
  CDS Start-End: 240-763
gccctgggaagcccgcaagaggcctcagcggtggccgtccgagagccgagaggtgagggtgcccccgcctcacctgcagaggggccgttccgggctcgaacccggcaccttccgggaaaacgggatcgcacgctccgtggtctttgtgttgagatctatccaggttgtggcctgtgcagggtcccccttctttcctatggctgaagaatatggcctcagtttcctcttggagcaggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttgaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccaccc

SEQ ID NO: 144584 - DNA, 2382 bp, Homo sapiens
  Payload ID: 8566
  Gene Symbol: IDH1
  Gene Name: isocitrate dehydrogenase 1 (NADP+), soluble
  Uniprot ID: O75874
  ENST ID: ENST00000345146
  CDS Start-End: 286-1530
ggcggggcctgggaggggacaaagccgggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccatt

SEQ ID NO: 144585 - DNA, 2441 bp, Homo sapiens
  Payload ID: 8566
  Gene Symbol: IDH1
  Gene Name: isocitrate dehydrogenase 1 (NADP+), soluble
  Uniprot ID: O75874
  ENST ID: ENST00000415913
  CDS Start-End: 383-1627
aggggaggggaggggcgggcgtggagacctggaaggaggtaccgatccagccttgattgcagccctcttgcacaacggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaa

SEQ ID NO: 144586 - DNA, 942 bp, Homo sapiens
  Payload ID: 8566
  Gene Symbol: IDH1
  Gene Name: isocitrate dehydrogenase 1 (NADP+), soluble
  ENST ID: ENST00000415282
  CDS Start-End: 471-942
ccagcaccagcgaggggaggggaggggaggggcgggcgtggagacctggaaggaggtaccgatccagccttgattgcagccctcttgcacaacggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggtactaaaaacagctaaattctcctgtgagtgttctgtatgttaacacttttattccttgttttgttttaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacac

SEQ ID NO: 144587 - DNA, 563 bp, Homo sapiens
  Payload ID: 8566
  Gene Symbol: IDH1
  Gene Name: isocitrate dehydrogenase 1 (NADP+), soluble
  ENST ID: ENST00000451391
  CDS Start-End: 378-563
aagaagccagggggactgcgcgcgtgagcgtcacgcatgcggggtcaacggatgggtgcttggtgctctgggcactgcaggggtgctggctggactgcggttaccgcagcgcggaaccccctaggcgaccccgcgctggccgggagcactctttcttcagccaaagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaa

SEQ ID NO: 144588 - DNA, 702 bp, Homo sapiens
  Payload ID: 8566
  Gene Symbol: IDH1
  Gene Name: isocitrate dehydrogenase 1 (NADP+), soluble
  ENST ID: ENST00000417583
  CDS Start-End: 482-702
cttgagcccaggaagtcaaggctgcagtgagcggtgatcgctccactgcactccagccagggcaacagagcaaggccctgtcttaaaaaagaaaataataagaatcccattcattatcttctaatgcaaacaatcaatggagtttctaaagacctagacataggtggtgtcaggacctgcttctgtaacttttccatcctttgcattaggcagcgcggaaccccctaggcgaccccgcgctggccgggagcactctttcttcagccaaagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgc

SEQ ID NO: 144589 - DNA, 2298 bp, Homo sapiens
  Payload ID: 8566
  Gene Symbol: IDH1
  Gene Name: isocitrate dehydrogenase 1 (NADP+), soluble
  Uniprot ID: O75874
  ENST ID: ENST00000446179
  CDS Start-End: 207-1451
agggggcgtggaggggcggagctccagcggccttcagaggggtcgctaggccacacggggcgagagggggctgggggaaacacccccgccagttccgggtgcctggagtttaaaaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaatta

SEQ ID NO: 144590 - DNA, 2694 bp, Homo sapiens
  Payload ID: 8567
  Gene Symbol: IDH2
  Gene Name: isocitrate dehydrogenase 2 (NADP+), mitochondrial
  Uniprot ID: P48735
  ENST ID: ENST00000330062
  CDS Start-End: 115-1473
gtgcccgcgcggccagcgcccgccaggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggccgggcacagtggcgcacgcctataatccctgtactttgggaggctgaggtgggtggatcacttgaggccaggagttcgagaccagcctggccaacatggtgaaaccccatctctactcaaaatacaaaaattagccaggcgtggtgatgcgcacctgcagtcccagctactcgggaggctgaggcaggaaaatggcttgaacctgggaggcagaggttgcagtgagccgagactgcaccactgcactccagcctgggtgacagagcaagactctgtctcaaaaaaaaaaaaaaaaaaaaaaaaaaaaaaattgctctatgcaagttttttagccccatgtaaaaaggaaaaataaaagttgctctaaagctacatataatcaaaa

SEQ ID NO: 144591 - DNA, 1453 bp, Homo sapiens
  Payload ID: 8567
  Gene Symbol: IDH2
  Gene Name: isocitrate dehydrogenase 2 (NADP+), mitochondrial
  Uniprot ID: P48735
  ENST ID: ENST00000540499
  CDS Start-End: 162-1364
aaggaaagaatattttggggctaaaagagccccgtgtctttgctgcctggtaattcctgcacgcatcttttcctattttgcaacgccataggcttccagcgactgctggtgatgtttctgatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagccc

SEQ ID NO: 144592 - DNA, 1278 bp, Homo sapiens
  Payload ID: 8567
  Gene Symbol: IDH2
  Gene Name: isocitrate dehydrogenase 2 (NADP+), mitochondrial
  ENST ID: ENST00000559482
  CDS Start-End: 88-1026
cccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcagtgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatg

SEQ ID NO: 144593 - DNA, 1449 bp, Homo sapiens
  Payload ID: 8567
  Gene Symbol: IDH2
  Gene Name: isocitrate dehydrogenase 2 (NADP+), mitochondrial
  ENST ID: ENST00000560061
  CDS Start-End: 79-195
agcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctact

SEQ ID NO: 144594 - DNA, 4128 bp, Homo sapiens
  Payload ID: 8568
  Gene Symbol: IDH3A
  Gene Name: isocitrate dehydrogenase 3 (NAD+) alpha
  Uniprot ID: P50213
  ENST ID: ENST00000299518
  CDS Start-End: 84-1184
cgtgcaggggcgggctccgagcgtggggtgggcgcttgcgcactgccgctgcggctgttgctgcggagccaggaggggaagcgatggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaatattctttccaagagcttttaatgaagcagagagctagtacttcattttcactggatacattttcagcatcatgagttgtcacagcctctgagcccctgatctgaagccagaagggctgagtgtattgtaaacttattcttgcatgttgctgtctgggaatggaccacactacagcaggtagttctgggggcgatactgccgaaaggcccgaacacatgtattttggctgcaattgaggaacttgggatgctattaattttgtatttcagcaactgccccttctcctatcccaaagcaccaattactgccctctgcctcagcagtaccagtataagatgacattccaaagactggaggcaactcagcctgagttaattcacaaaattatgccatgctggggcttgagcttgagcttgggcttaggcttgggctcagcttttgaccctcaggcatctcctttcccttcctgtcttcctctcccttctcctctgctgcagcatgattttcttaatcttcagacactcactattttcatgaacagttaccctctgtccccacaaccaaagacaactcatggcctcctttggcccttgtgtaacattgcaaacctgtggctttgcaaaatgtacccaggtcacaaggggatttttttttttttagcaatgatatccctgtctgggtcactttttaagcttgtaaccgcccccccagacttataatcttaaatgtattttcctttgtttaagctgctgcttcctctgtttcattggattgtgccagttatcagtggctcttgggttcaaagtaataaagaattccaaaactgagatgtttgctttctctacctgtttcctgttcagatgccttcggtcattttggctcagcttgctactgagaatggctgcttcccgtattcagaatggaagtggggtggtctggtggcgacaggctaacgtagagctggctgcttttatgagaatgcgccacttgaccccatcctgcacctttgtttattccagggcactaatggtcactcgcatgcccgctgtgcacagtcctgtgagttaaatgcccactactctctgcactggtcccacctgctcaattgacaaaaaaaatcaggtccttgttgacagttctgttaaaaggtttaatattcaaattatacattaaatagaatcaaacaggcagcagcagttttattaagcatcaagtcagttggcatgtgggtggcggagtgcctggtaatggaataatagggtcggcgatgcccgccaagattccagagtaagtcaggtcgctaggtgagttgtgactgattgcttttcctgcagcgcacgtgagcagtatcagccatctctctcctacccgctccacagcctactgctggctgtcctgtatgtgagctagcagctttttaatctacctggaactaaggccaaaaattatcagccctttcgttctggaaggagagctgatctcatttgtcacctgaacaaaaagcaatacttaaactgaattaaaactacccacacgtgaagcttcttggaattgtcagctattgttggcgtaagacctggtaaatgtagagccagtgctgtgccctgacctggagatctaacagacttggcagaaatgcctgtgcccagactgaagagacctggggctcaggaagaggctcggaacgcctgccctctattctatagaaactgcaggcataggccctgattacattttttgctcttggtaaaaggagtcaatgatacctttgtacttctccaaaactgtgagccgtttcagtttcatcgtgggacctaaaagggaaatgagaagaaatgagtgaggcccaggctctgagaactctgagaatgtgtgtggtaaagactcacactcagtcctatatataactcaggaattaagccagataatcaggaccgtcagtagccagcctccaagacagtgatcgctcctggtattcatatggcttgtgtgtagtctcctgtgttataccactggttgtggccagtggagtatagatgaagggttggtatgtcacctctgagaataggttataaaagatcagtttcttttatacacataggaaagtagtgtaagctacatctgccttttccttgacctgtacccagttttgaccctcagtccattttctctgaaatggatttatttgttccatctcttgaatgaataaattgttgaagcaattaaaaaataga

SEQ ID NO: 144595 - DNA, 878 bp, Homo sapiens
  Payload ID: 8568
  Gene Symbol: IDH3A
  Gene Name: isocitrate dehydrogenase 3 (NAD+) alpha
  ENST ID: ENST00000558933
  CDS Start-End: 79-261
aggggcgggctccgagcgtggggtgggcgcttgcgcactgccgctgcggctgttgctgcggagccaggaggggaagcgatggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccaca

SEQ ID NO: 144596 - DNA, 744 bp, Homo sapiens
  Payload ID: 8568
  Gene Symbol: IDH3A
  Gene Name: isocitrate dehydrogenase 3 (NAD+) alpha
  ENST ID: ENST00000559186
  CDS Start-End: 418-744
gctgcggctgttgctgcggagccaggaggggaagcgatggctgggcccgcgtggatctctaaggtctctcggctgctgggggcattccacaacccaaaacagatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtg

SEQ ID NO: 144597 - DNA, 567 bp, Homo sapiens
  Payload ID: 8568
  Gene Symbol: IDH3A
  Gene Name: isocitrate dehydrogenase 3 (NAD+) alpha
  ENST ID: ENST00000559106
  CDS Start-End: 1-109
tgggcccgcgtggatctctaaggtctctcggctgctgggggcattccacaacccaaaacaggtgaccagaggttttactggtggtatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctg

SEQ ID NO: 144598 - DNA, 2110 bp, Homo sapiens
  Payload ID: 8568
  Gene Symbol: IDH3A
  Gene Name: isocitrate dehydrogenase 3 (NAD+) alpha
  ENST ID: ENST00000560667
  CDS Start-End: 45-158
gcactgccgctgcggctgttgctgcggagccaggaggggaagcgatggctgggcccgcgtggatctctaaggtctctcggctgctgggggcattccacaacccaaaacaggtgaccagaggttttactggtggtatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgtcctttacagaaattactgagtgtgaataaaaacttcagatccaagaaatatataatgagagatataatttttgttaataagacaaaggtaatatattggatacaaagacacaaatgtattgtgtgttcaattattttgttgtcttgagatttaat

SEQ ID NO: 144599 - DNA, 1595 bp, Homo sapiens
  Payload ID: 8568
  Gene Symbol: IDH3A
  Gene Name: isocitrate dehydrogenase 3 (NAD+) alpha
  ENST ID: ENST00000558554
  CDS Start-End: 45-1040
gcactgccgctgcggctgttgctgcggagccaggaggggaagcgatggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatgcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattctaaaccattttacacttaagttaaaatagtttctcttcagctgtaaataacaggatacagaattaacaagagaaaatgtctaactttttaagaaaaaccttattttcttcggtttttgaaaaacataatggaaataaaacaggatattgacataatagcacaaaatgacactcttctaaaactaaatgggcacaagagaattttcctgggaaagttcacatcaaaaagagtgaatgtggtatatttctaaatgatatggaaaatagagacagatttgt

SEQ ID NO: 144600 - DNA, 483 bp, Homo sapiens
  Payload ID: 8568
  Gene Symbol: IDH3A
  Gene Name: isocitrate dehydrogenase 3 (NAD+) alpha
  ENST ID: ENST00000560396
  CDS Start-End: 32-160
ggctgttgctgcggagccaggaggggaagcgatggctgggcccgcgtggatctctaaggtctctcggctgctgggggcattccacaacccaaaacaggtgaccagaggttttactggtggtgagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtg

SEQ ID NO: 144601 - DNA, 738 bp, Homo sapiens
  Payload ID: 8568
  Gene Symbol: IDH3A
  Gene Name: isocitrate dehydrogenase 3 (NAD+) alpha
  ENST ID: ENST00000559881
  CDS Start-End: 335-738
gttgctgcggagccaggaggggaagcgatggctgggcccgcgtggatctctaagattctactttgtcaccctcttcagacccagatttgcttgtgatgataactcttatgtcacatttgctcctaaaagtaaagcaacttctgtgtcactgtgaaaactgaactcagtcctttaatctctgaacttacatttaacacccaattcatctttggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttga

SEQ ID NO: 144602 - DNA, 1008 bp, Homo sapiens
  Payload ID: 8568
  Gene Symbol: IDH3A
  Gene Name: isocitrate dehydrogenase 3 (NAD+) alpha
  ENST ID: ENST00000559803
  CDS Start-End: 25-207
gctgcggagccaggaggggaagcgatggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatacttttttttcagcagtttttatttgattaaatacaggcggatgtcagatgggctttttctacaaaaatgcagggaagttgcagaaagctgtaaagatattaaatttaatgagatgtaccttgatacagtatgtttgaatatggtacaagatccttcccaatttgatgttcttgttatgccaaatttgtatggagacatccttagtgacttgtgtgcaggattgatcggaggtctcggtgtgacaccaagtggcaacattggagccaatggggttgcaatttttgagtcggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttc

SEQ ID NO: 144603 - DNA, 568 bp, Homo sapiens
  Payload ID: 8568
  Gene Symbol: IDH3A
  Gene Name: isocitrate dehydrogenase 3 (NAD+) alpha
  ENST ID: ENST00000559865
  CDS Start-End: 28-141
gttgctgcggagccaggaggggaagcgatggctgggcccgcgtggatctctaaggtctctcggctgctgggggcattccacaacccaaaacaggtgaccagaggttttactggtggtatcaactttgccaagcttatgtagattactcttagatttaagcagacagttttatagaggaactaagaaaaaaatggaagctctcttgataaaaagtctgattttccctgagtaccaaaacagacctcagtaatattttggaaatgtgtctgaaaatgttttgcaagactgaagaagttgcatgagaagctttccaggatcacaatggaaaggaaaggaaaacacttgccttcatgagaaaccgtctaaattttagttcagacagtaactttaattccaggagatggtattggcccagaaatttcagctgcagttatgaagatttttgatgctgccaaagccctttgaagaccccaatagcagccggtcacccatctatgaatttactgctgcgcaaaacatttgacctttacgcgaatgtccgaccatgtgtctctatcgaaggctataa

SEQ ID NO: 144604 - DNA, 424 bp, Homo sapiens
  Payload ID: 8568
  Gene Symbol: IDH3A
  Gene Name: isocitrate dehydrogenase 3 (NAD+) alpha
  ENST ID: ENST00000557960
  CDS Start-End: 1-146
gactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctaccgcacgtgagcagtatcagccatctctctcctacccgctccacagcctactgctggctgtcctgtatgtgagctagcagctttttaatctacctggaactaaggccaaaaattatcagccctttcgttctggaaggagagctgatctcatttgtcacctgaacaaaaagcaatacttaaactgaattaaaactacccacacgtgaa

SEQ ID NO: 144605 - DNA, 587 bp, Homo sapiens
  Payload ID: 8568
  Gene Symbol: IDH3A
  Gene Name: isocitrate dehydrogenase 3 (NAD+) alpha
  ENST ID: ENST00000557826
  CDS Start-End: 449-587
actgccgctgcggctgttgctgcggagccaggaggggaagcgatggctgggcccgcgtggatctctaaggttgtggccaggcatggtggctcatgcctgtaattctagcactttgggaggccaaagtgggcggatcacttgaggtcgggagttcaagaccagcctggccaacatggcgaaaccccatctctactaaaaatacaaaaatttgctgggcgtggtggcgcacgcctgtaatcccagctactcgggaggctgaggcaggagagtcacttgaacccaggaggtggaggctgcggtgagaggagatcatgctcctacctgggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagcacctattcagtgggaggagcggaacgtcactgccattcaaggacctggaggaaagtggatgatcccttcagaggctaaagagtccatggataagaacaagatgggcttgaaag

SEQ ID NO: 144606 - DNA, 569 bp, Homo sapiens
  Payload ID: 8568
  Gene Symbol: IDH3A
  Gene Name: isocitrate dehydrogenase 3 (NAD+) alpha
  ENST ID: ENST00000561279
  CDS Start-End: 43-569
actgccgctgcggctgttgctgcggagccaggaggggaagcgatggctgggcccgcgtggatctctaaggtctctcggctgctgggggcattccacaacccaaaacaggtgaccagaggttttactggtggtgcacctattcagtgggaggagcggaacgtcactgccattcaaggacctggaggaaagtggatgatcccttcagaggctaaagagtccatggataagaacaagatgggcttgaaaggccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcat

SEQ ID NO: 144607 - DNA, 389 bp, Homo sapiens
  Payload ID: 8568
  Gene Symbol: IDH3A
  Gene Name: isocitrate dehydrogenase 3 (NAD+) alpha
  ENST ID: ENST00000561366
  CDS Start-End: 1-138
atggtacaagatccttcccaatttgatgttcttgttatgccaaatttgtatggagacatccttaggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaaggtaacaggaatcttgatttacttgtgctgggtaaaatgcattgcttccatgtgttttatctgagtgaaagggacagtgacagataatagttctcaggcgggcccaagcatttgatgttgaacaaggattcttaacgtgggtcccagattgaacagggtatgtgtgcacatg

SEQ ID NO: 144608 - DNA, 586 bp, Homo sapiens
  Payload ID: 8568
  Gene Symbol: IDH3A
  Gene Name: isocitrate dehydrogenase 3 (NAD+) alpha
  ENST ID: ENST00000560770
  CDS Start-End: 563-586
gttgctgcggagccaggaggggaagcgatggctgggcccgcgtggatctctaagaatagatataatgtataattgaaggagcactggaccaggagtcagaagacctgtatgtgggtttccattttgccaattattcgctgtgtgaccttaggcaaatgcttttctttgggaccagcatctccgcttatgaaataagcaagttgccaggtgtcgtggtgcacacctgtaatcccacctactcaggaggctgaggcaagagggtcacttgagcccaggagttggagactgcagtgagttatgattgtgcctttgaatagtcactgcactccatcctgggcaacctagggagaccccatctcaaaaagcctaaaacaacaacaagaaataagtgagttgtgctctggatttcatgaggaacatcctggctctaaaattaatggtctctcggctgctgggggcattccacaacccaaaacaggtgaccagaggttttactggtggtgttcagacagtaactttaattccaggagatggtattggcccagaaatttcagctgcagttatgaagatttttgatgctgccaaa

SEQ ID NO: 144609 - DNA, 566 bp, Homo sapiens
  Payload ID: 8568
  Gene Symbol: IDH3A
  Gene Name: isocitrate dehydrogenase 3 (NAD+) alpha
  ENST ID: ENST00000559205
  CDS Start-End: 25-288
gctgcggagccaggaggggaagcgatggctgggcccgcgtggatctctaaggttcatgggacggctccagacattgcaggcaaggacatggcgaatcccacagccctcctgctcagtgccgtgatgatgctgcgccacatgggactttttgaccatgctgcaagaattgaggctgcgtgttttgctacaattaaggacggaaagagcttgacaaaagatttgggaggcaatgcaaaatgctcagacttcacagaggaaatctgtcgccgagtaaaagatttagattaacacttctacaactggcatttacatcagtcactctaaatggacaccacatgaacctctgtttagaatacctacgtatgtatgcattggtttgcttgtttcttgacagtacatttttagatctggccttttcttaacaaaatctgtgcaaaagatgcaggtggatgtccctaggtctgttttcaaagaactttttccaagtgcttgttttatttattaagtgtctacctggtaaatgttttttttgtaaactctgagtggactgtatcatttgctattct

SEQ ID NO: 144610 - DNA, 617 bp, Homo sapiens
  Payload ID: 8568
  Gene Symbol: IDH3A
  Gene Name: isocitrate dehydrogenase 3 (NAD+) alpha
  ENST ID: ENST00000558509
  CDS Start-End: 28-210
gttgctgcggagccaggaggggaagcgatggctgggcccgcgtggatctctaaggtctctcggctgctgggggcattccacaacccaaaacaggtgaccagaggttttactggtggtgttcagacagtaactttaattccaggagatggtattggcccagaaatttcagctgcagttatgaagatttttgatgctgccaaagccctttgaagaccccaatagcagccggtcacccatctatgaatttactgctgcgcaaaacatttgacctttacgcgaatgtccgaccatgtgtctctatcgaaggctataaaaccccttacaccgatgtaaatattgtgaccattcgagagaacacagaaggagaatacagtggaattgagcatgtgattgttgatggagtcgtgcagagtatcaagctcatcaccgagggggcgagcaagcgcattgctgagtttgcctttgagtatgcccggaacaaccaccggagcaacgtcacggcggtgcacaaagccaacatcatacttttttttcagcagtttttatttgattaaatacaggcggatgtcagatgggctttttctacaaaaatgcagggaagttgcagaaagctgtaa

SEQ ID NO: 144611 - DNA, 114 bp, Homo sapiens
  Payload ID: 8568
  Gene Symbol: IDH3A
  Gene Name: isocitrate dehydrogenase 3 (NAD+) alpha
  ENST ID: ENST00000629769
  CDS Start-End: 1-114
atggctgggcccgcgtggatctctaaggtctctcggctgctgggggcattccacaacccaaaacaggtgaccagaggttttactggtggtatcaactttgccaagcttatgtag

SEQ ID NO: 144612 - DNA, 1545 bp, Homo sapiens
  Payload ID: 8569
  Gene Symbol: IDH3B
  Gene Name: isocitrate dehydrogenase 3 (NAD+) beta
  Uniprot ID: O43837
  ENST ID: ENST00000380843
  CDS Start-End: 32-1189
gtcacttcccacgcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaaccaa

SEQ ID NO: 144613 - DNA, 1230 bp, Homo sapiens
  Payload ID: 8569
  Gene Symbol: IDH3B
  Gene Name: isocitrate dehydrogenase 3 (NAD+) beta
  Uniprot ID: O43837
  ENST ID: ENST00000380851
  CDS Start-End: 32-1183
gtcacttcccacgcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggttcgaacctctgacatgggtggctatgctacttgccatgacttcactgaggctgtcattgctgccttgccccacccataggccctgtccatacccatgtaaggtgttcaataaagaacatgaaccaa

SEQ ID NO: 144614 - DNA, 1279 bp, Homo sapiens
  Payload ID: 8569
  Gene Symbol: IDH3B
  Gene Name: isocitrate dehydrogenase 3 (NAD+) beta
  ENST ID: ENST00000474315
  CDS Start-End: 2-1165
catggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaaggttcgaacctctgacatgggtggctatgctacttgccatgacttcactgaggctgtcattgctgccttgccccacccataggccctgtccatacccatgtaaggtgttcaataaagaacatgaaccaa

SEQ ID NO: 144615 - DNA, 1400 bp, Homo sapiens
  Payload ID: 8569
  Gene Symbol: IDH3B
  Gene Name: isocitrate dehydrogenase 3 (NAD+) beta
  ENST ID: ENST00000613370
  CDS Start-End: 32-1162
gtcacttcccacgcgacttcctgcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaagatcccatctgctgttccctctttcctgctccatccactgcccttttcatgggccatctgaatgcagaacttgcagctctccttgggggtggaacagcaagggatacaggcaggctgaagcatcagcttcaccttcacgccccatctccttttcgctgtgattctttccttccacctggtcttgtctctatttcttccaaggaaggtagccacatcctgcctctgatctgcgtttcccatcatctttgcctgctcagcctcctgtcctgccctggctgcagcacagctaatagtggctt

SEQ ID NO: 144616 - DNA, 608 bp, Homo sapiens
  Payload ID: 8569
  Gene Symbol: IDH3B
  Gene Name: isocitrate dehydrogenase 3 (NAD+) beta
  ENST ID: ENST00000477689
  CDS Start-End: 1-251
ccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatga

SEQ ID NO: 144617 - DNA, 677 bp, Homo sapiens
  Payload ID: 8569
  Gene Symbol: IDH3B
  Gene Name: isocitrate dehydrogenase 3 (NAD+) beta
  ENST ID: ENST00000466494
  CDS Start-End: 1-436
caaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggttcgaacctctgacatgggtggctatgctacttgccatgacttcactgaggctgtcattgctgccttgccccacccataggccctgtccatacccatgtaaggtgttcaataaagaacatgaaccaa

SEQ ID NO: 144618 - DNA, 1485 bp, Homo sapiens
  Payload ID: 8570
  Gene Symbol: IDH3G
  Gene Name: isocitrate dehydrogenase 3 (NAD+) gamma
  Uniprot ID: P51553
  ENST ID: ENST00000217901
  CDS Start-End: 198-1379
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctaga

SEQ ID NO: 144619 - DNA, 1712 bp, Homo sapiens
  Payload ID: 8570
  Gene Symbol: IDH3G
  Gene Name: isocitrate dehydrogenase 3 (NAD+) gamma
  Uniprot ID: P51553
  ENST ID: ENST00000370092
  CDS Start-End: 187-1329
ggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctaga

SEQ ID NO: 144620 - DNA, 1662 bp, Homo sapiens
  Payload ID: 8570
  Gene Symbol: IDH3G
  Gene Name: isocitrate dehydrogenase 3 (NAD+) gamma
  ENST ID: ENST00000370093
  CDS Start-End: 56-1078
tctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagtgagtggctcccagtgccccgcaagcccctggccagccctccgggccccagggactgaaggctggctgtcccatcctctaggctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctag

SEQ ID NO: 144621 - DNA, 739 bp, Homo sapiens
  Payload ID: 8570
  Gene Symbol: IDH3G
  Gene Name: isocitrate dehydrogenase 3 (NAD+) gamma
  ENST ID: ENST00000454076
  CDS Start-End: 1-634
caagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctag

SEQ ID NO: 144622 - DNA, 888 bp, Homo sapiens
  Payload ID: 8570
  Gene Symbol: IDH3G
  Gene Name: isocitrate dehydrogenase 3 (NAD+) gamma
  ENST ID: ENST00000444450
  CDS Start-End: 34-888
tgtcgggacgtgcggaggctctcactttccgtcatggcgctgaaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaaca

SEQ ID NO: 144623 - DNA, 597 bp, Homo sapiens
  Payload ID: 8570
  Gene Symbol: IDH3G
  Gene Name: isocitrate dehydrogenase 3 (NAD+) gamma
  ENST ID: ENST00000444338
  CDS Start-End: 1-597
cacgtgagttccaatgctgatgaagaggacattcgcaatgccatcatggccatccgccggaaccgcgtggccctgaaggggcttgtctggctagagaggaccctcgtgcttggagactgggtggacgcctcctcgggcctgtttgcgctgcgatgctgggattcgagcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcag

SEQ ID NO: 144624 - DNA, 1526 bp, Homo sapiens
  Payload ID: 8570
  Gene Symbol: IDH3G
  Gene Name: isocitrate dehydrogenase 3 (NAD+) gamma
  ENST ID: ENST00000427365
  CDS Start-End: 207-1175
cgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagtaagtacctgccccctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacg

SEQ ID NO: 144625 - DNA, 1339 bp, Homo sapiens
  Payload ID: 8570
  Gene Symbol: IDH3G
  Gene Name: isocitrate dehydrogenase 3 (NAD+) gamma
  ENST ID: ENST00000619865
  CDS Start-End: 371-1339
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggttctaggcgcccacgaggtcccctcgaggaacatcttttcagtaacccacagcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgaaactgggcgatgggcttttcctccagtgctgcagggaggtggcagcccgctaccctcagatcaccttcgagaacatgattgtggataacaccaccatgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagctacgaggaacaccggcaagagtatcgccaataagaacatcgccaaccccacggccaccctgctggccagctgcatgatgctggaccacctcaagctgcactcctatgccacctccatccgtaaggctgtcctggcatccatggacaatgagaatgtgaggttcccctcgcaccctaccctgctgccccgcccagtctccccctgcagcctcctgtag

SEQ ID NO: 144626 - DNA, 697 bp, Homo sapiens
  Payload ID: 8571
  Gene Symbol: IARS
  Gene Name: isoleucyl-tRNA synthetase
  ENST ID: ENST00000375627
  CDS Start-End: 81-605
ctgattaacagtgtagctgcttctccatagggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggcgagatgcagtggatcattcctgaaatctaccacttttggaagccaaggtggagtattgctcctggaaaatccaaaaggtgacaataggttggaccttttaaagctgaagagtgttgtcactagcatttttggtgtgaaaaatacagagctggctgtcttccatgatgaaacag

SEQ ID NO: 144627 - DNA, 4656 bp, Homo sapiens
  Payload ID: 8571
  Gene Symbol: IARS
  Gene Name: isoleucyl-tRNA synthetase
  Uniprot ID: P41252
  ENST ID: ENST00000375643
  CDS Start-End: 268-4056
tccgtgcgcccggttgcagcgtggacgccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttccaaaa

SEQ ID NO: 144628 - DNA, 1103 bp, Homo sapiens
  Payload ID: 8571
  Gene Symbol: IARS
  Gene Name: isoleucyl-tRNA synthetase
  ENST ID: ENST00000395554
  CDS Start-End: 114-1103
agcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgct

SEQ ID NO: 144629 - DNA, 414 bp, Homo sapiens
  Payload ID: 8571
  Gene Symbol: IARS
  Gene Name: isoleucyl-tRNA synthetase
  ENST ID: ENST00000430417
  CDS Start-End: 197-414
cggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgagcaacaaaatgcttcaacaagttccagaaaacataaattttcctgctgaagaagagaaaatcttggagttttggactgaatttaattgttttcaggaatgcttaaagcaatcaaaacataaaccaaagaatatgaaattgataagacactgggaatcagaggaccagaggatgtggccaaaatggggattacagagtataacaatcagtgccga

SEQ ID NO: 144630 - DNA, 4341 bp, Homo sapiens
  Payload ID: 8571
  Gene Symbol: IARS
  Gene Name: isoleucyl-tRNA synthetase
  ENST ID: ENST00000443024
  CDS Start-End: 92-3820
cgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatcccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagat

SEQ ID NO: 144631 - DNA, 4186 bp, Homo sapiens
  Payload ID: 8571
  Gene Symbol: IARS
  Gene Name: isoleucyl-tRNA synthetase
  ENST ID: ENST00000447699
  CDS Start-End: 266-3724
gcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaagaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagat

SEQ ID NO: 144632 - DNA, 4587 bp, Homo sapiens
  Payload ID: 8571
  Gene Symbol: IARS
  Gene Name: isoleucyl-tRNA synthetase
  ENST ID: ENST00000627121
  CDS Start-End: 2995-3519
cggtgcggagcctgtctccttcactggatcccgcattttcagcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggcgagatgcagtggatcattcctgaaatctaccacttttggaagccaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatataaatgtgttgaaagtaattcattctcccatagataaatgaaacttgaaatgtgtaaactttgaagaacataaaaacttcatggtggtttcttattaagacagtggactagacatctaataaaacttctttcc

SEQ ID NO: 144633 - DNA, 3560 bp, Homo sapiens
  Payload ID: 8572
  Gene Symbol: IARS2
  Gene Name: isoleucyl-tRNA synthetase 2, mitochondrial
  Uniprot ID: Q9NSE4
  ENST ID: ENST00000366922
  CDS Start-End: 116-3154
cttccgctcccggagcgcgtgcgccctcttactcggctccccttggtttcctggggtcctgccccttcaagctggggcgggagcggaggaccccgctctcaggggttgccggaccatgcgttgggggctgcgccctcgcgggccgggcgcggccgccctggccactgcccgaagtttgtgggggacgccccgccttccctgcagcccgggatggcaaggggcgacgaagaggcttctggtgcggtcggtctccggggccagtaaccaccagccgaactcgaatagtggcagataccgggacacggtgctgctgccgcagacgagcttccccatgaagctgctgggccgccagcagccggacacggagctggagatccagcagaaatgtggattttcagaactttattcatggcaaagagaaagaaaagtaaagacagaattttgccttcatgatggacctccttatgcaaacggtgaccctcatgttggacatgctttaaataagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaagctagatcatttgctaaagcagccattgagaaacagaaatcagcatttattcgttggggaataatggcagattggaataattgctactatacatttgatgggaagtatgaagccaaacagttgagaactttttaccaaatgtatgataagggcttggtttatcgatcttacaaacctgtgttttggtctccgtcatctaggactgcattggctgaagcagaacttgaatataatcctgagcatgtcagtcgttcaatatatgtaaaatttcctctcttaaagccttctccaaaattggcatctcttatagatggttcatctcctgttagtattttggtctggaccacacaaccttggacgattccagccaatgaagctgtttgctatatgcctgaatcaaagtatgctgttgtgaaatgttctaagtctggagacctctacgtactggcggcagataaagtagcatctgttgcttctactttggaaacaacatttgagactatttcaacactttcaggtgtagatttggaaaatggtacttgcagtcatccattaattcctgataaagcctctcctcttttacctgcaaatcatgtgaccatggcaaaaggaacgggattggttcacacagccccagctcatggtatggaagactacggtgtagcgtctcagcacaacctgcccatggattgtctagtggacgaagatggagttttcacagatgttgcaggtcctgaacttcaaaacaaggctgtccttgaagagggaactgatgtggttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggaattgttaaaaaaggtgaaatttattcctggatcagcactgaatggcatggttgaaatgatggacaggcggccatattggtgtatatcaaggcaaagagtttggggtgttccaattcctgtgtttcatcataagaccaaggatgaatacttgatcaacagccaaaccactgagcatattgttaaactagtggaacaacacggcagtgatatctggtggactcttccccctgaacaacttcttccaaaagaagtcttatctgaggttggtggccctgatgccttggaatatgtgccaggtcaggatattttggacatctggtttgatagcggaacttcatggtcttatgttcttccaggtcctgaccaaagagcagatttgtacttggaaggaaaagaccagctcgggggttggtttcagtcatccttattaacaagtgtggcagcaaggaagagagcaccttataagacagtgattgttcatggatttacccttggagaaaagggagaaaagatgtccaagtctcttgggaatgtcattcatcctgatgttgtcgttaatggaggacaagatcaaagcaaagagcctccgtatggtgctgatgtccttcgctggtgggtagctgattccaatgtcttcaccgaagttgcaattggcccatccgtgctcaatgctgccagagatgatattagcaagcttaggaatacacttcgctttcttttgggaaatgtggctgatttcaacccagaaacagattccatccctgtaaacgatatgtatgtcatagaccagtacatgctacacttactgcaggatttggcaaacaagattaccgaattatacaaacaatatgattttggaaaagttgttcggctgttacggacgttttataccagagagctctctaacttttatttcagtataatcaaagataggctctattgtgaaaaggaaaatgaccccaaacgacgctcttgtcagactgcattagttgaaattttggatgtaatagttcgttcttttgctcccattcttcctcacctggctgaagaggtgttccagcacataccttatattaaagagcccaagagtgttttccgtactgggtggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaata

SEQ ID NO: 144634 - DNA, 2301 bp, Homo sapiens
  Payload ID: 8573
  Gene Symbol: IDI1
  Gene Name: isopentenyl-diphosphate delta isomerase 1
  Uniprot ID: Q13907
  ENST ID: ENST00000381344
  CDS Start-End: 168-1022
gggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagttaaatgtttgttaaattcaatagaatgactcatttatggttaactttgggcaatttataatttcagacaagactgtttagcaagtattttattgaaaagtaaaaaaaattgcaatttaa

SEQ ID NO: 144635 - DNA, 1017 bp, Homo sapiens
  Payload ID: 8573
  Gene Symbol: IDI1
  Gene Name: isopentenyl-diphosphate delta isomerase 1
  ENST ID: ENST00000429642
  CDS Start-End: 652-1017
tgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaaccgagtcgcaggagactaagagttgcgagtctccccttagagaattcagaaacaagcgtagacagcatcgtcagaaacacgagcgtgacgacaccggcctccccgtgccgagtccacgcgtgtgacgcgggtgcatacacctgcgtccgtgcaagagggtgacagcaacacactcaaggcgcttctcctgggaatggagcaggagaagagatggggagcatcgcatagatggaactagacctttttcttgggttggatgatgtgttcccgcgtctactacatgtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagag

SEQ ID NO: 144636 - DNA, 441 bp, Homo sapiens
  Payload ID: 8573
  Gene Symbol: IDI1
  Gene Name: isopentenyl-diphosphate delta isomerase 1
  ENST ID: ENST00000427898
  CDS Start-End: 80-441
tgcaagagggtgacagcaacacactcaaggcgcttctcctgggaatggagcaggagaagagatggggagcatcgcatagatggaactagacctttttcttgggttggatgatgtgttcccgcgtctactacatggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaa

SEQ ID NO: 144637 - DNA, 1359 bp, Homo sapiens
  Payload ID: 8574
  Gene Symbol: IDI2
  Gene Name: isopentenyl-diphosphate delta isomerase 2
  Uniprot ID: Q9BXS1
  ENST ID: ENST00000277517
  CDS Start-End: 66-749
gagttccacatctgatacccaggagtctccagcttccaagagaggtcgggtcacagccagcagctatgtctgacataaatcttgactgggttgacaggcgtcagttgcagcgcttggaggaaatgctgattgttgtggatgagaatgataaggttattggtgccgacaccaagaggaattgccatctgaacgaaaacattgagaaagggctgctgcaccgagccttcagcgttgtcttgtttaacaccaagaatcgaatcctgatacagcagaggtcggacacgaaagtcacgtttcctgggtattttaccgactcctgtagtagccacccattatacaacccagcagaactggaagaaaaggatgccatcggagtgaggagggcagcccagaggcgtctgcaagcagagctgggaattcctggggagcagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcggactagcctggctggaccatgaggctgtctccccacagctttatccaagcctccaaggtcaggatgggatctctgtatcatgtttttctttttaaatcacttatttcagagtgcaacacaaggctgcatttttaaaaaaaagacacattcaatcttgcatcctaatacaagcagtacggaagatgcgtatggtctcagccaagtgactcgacgtttatccacttctgttcatttgatcgtttcagtaatatgcttacaaataaagacatacttgctttaaaacat

SEQ ID NO: 144638 - DNA, 1709 bp, Homo sapiens
  Payload ID: 8575
  Gene Symbol: ISPD
  Gene Name: isoprenoid synthase domain containing
  Uniprot ID: A4D126
  ENST ID: ENST00000399310
  CDS Start-End: 1-1206
atggaggccgggccgccgggcagcgccaggccggcggagccgggtccttgcctgagtggtcagcgcggcgcggaccacacggcttccgcctccctgcagagcgtggccgggaccgagcccgggcgccacccgcaagccgtggcagctgtgttgcctgccggggggtgcggggagaggatgggggtccccaccccgaagcaattctgccccatcctggagaggccgctcatcagctacaccctacaggccctggagagagtatgttggataaaggacattgttgtggcagtaactggagagaacatggaagtaatgaaaagtattattcagaagtatcagcataaacgcatctcactggtcgaagctggagtgacccgccacaggtcaattttcaatggactaaaagcactggcagaagatcagatcaactctaaactctctaagccagaagtagtgattatccatgatgctgtgagaccatttgttgaggaaggtgtccttcttaaagttgtcacagctgctaaggaacacgggtgtagtgactatgacttggaatttggaactgagtgtttgcaattggccctaaaatactgttgcactaaagccaaacttgtagaaggatcacctgacctctggaaggtgacctacaaacgagatctctatgcggctgaatcgattattaaggagagaatttcccaagagatttgtgtagttatggatacagaagaagataacaaacatgtaggtcatcttcttgaagaagtgctgaaaagtgaattaaatcatgtaaaagtcacatctgaggctctgggtcatgctggcagacatcttcagcaaatcatcttagatcaatgctacaattttgtttgtgtgaatgttacaacctctgattttcaagaaacccagaagttactgagcatgcttgaagagagtagtctttgcattttatatcctgttgttgttgtttcagttcattttcttgattttaaattagtacctcccagtcagaaaatggaaaacctaatgcagattagagaatttgcaaaggaagtaaaagaaagaaatattttgttatatgggcttctcatatcttacccacaggatgatcagaagctacaggagagtttaaggcaaggtgctatcattattgcttcattaatcaaggaaagaaattctggactcattggtcagcttctgatagcatgaagaacacaaaaaattacctattttctaaaacatctatttgcgtatcttaattgtgctttgtgcccccgctgctgtgtgtggtagaatgtttcagttgtcttttatatcttctctataatttgtaggatgtgatgcttagattataaagcagattaatgtttatatctgtgaaataaagaatacttttgtgtatgacaaatattaattgcctgaaccagaaaaaaatagtagataagtggaaaataatagccttcaaatgaatctttccacagagacatgaacggtcaaatagaaataatgatggggtgagctattctttcaaggaatgagaatttagaaaacttcagttattatcctaactgttaattaataatttacactattatgaagctaatggataaacttcagaattattctcacttctataattgtcctgtcaccaggtgatattttgtctttttgtcttgtgttaaaaatgtctacactttaataaaaaagggtga

SEQ ID NO: 144639 - DNA, 5524 bp, Homo sapiens
  Payload ID: 8575
  Gene Symbol: ISPD
  Gene Name: isoprenoid synthase domain containing
  Uniprot ID: A4D126
  ENST ID: ENST00000407010
  CDS Start-End: 1-1356
atggaggccgggccgccgggcagcgccaggccggcggagccgggtccttgcctgagtggtcagcgcggcgcggaccacacggcttccgcctccctgcagagcgtggccgggaccgagcccgggcgccacccgcaagccgtggcagctgtgttgcctgccggggggtgcggggagaggatgggggtccccaccccgaagcaattctgccccatcctggagaggccgctcatcagctacaccctacaggccctggagagagtatgttggataaaggacattgttgtggcagtaactggagagaacatggaagtaatgaaaagtattattcagaagtatcagcataaacgcatctcactggtcgaagctggagtgacccgccacaggtcaattttcaatggactaaaagcactggcagaagatcagatcaactctaaactctctaagccagaagtagtgattatccatgatgctgtgagaccatttgttgaggaaggtgtccttcttaaagttgtcacagctgctaaggaacacggggcagcaggagccattcgacctcttgtatctactgtcgtcagtccatctgctgatggttgcttagactactcgctagaacgtgccagacacagagcaagtgaaatgccccaagcttttctatttgatgtgatttatgaagcatatcagcagtgtagtgactatgacttggaatttggaactgagtgtttgcaattggccctaaaatactgttgcactaaagccaaacttgtagaaggatcacctgacctctggaaggtgacctacaaacgagatctctatgcggctgaatcgattattaaggagagaatttcccaagagatttgtgtagttatggatacagaagaagataacaaacatgtaggtcatcttcttgaagaagtgctgaaaagtgaattaaatcatgtaaaagtcacatctgaggctctgggtcatgctggcagacatcttcagcaaatcatcttagatcaatgctacaattttgtttgtgtgaatgttacaacctctgattttcaagaaacccagaagttactgagcatgcttgaagagagtagtctttgcattttatatcctgttgttgttgtttcagttcattttcttgattttaaattagtacctcccagtcagaaaatggaaaacctaatgcagattagagaatttgcaaaggaagtaaaagaaagaaatattttgttatatgggcttctcatatcttacccacaggatgatcagaagctacaggagagtttaaggcaaggtgctatcattattgcttcattaatcaaggaaagaaattctggactcattggtcagcttctgatagcatgaagaacacaaaaaattacctattttctaaaacatctatttgcgtatcttaattgtgctttgtgcccccgctgctgtgtgtggtagaatgtttcagttgtcttttatatcttctctataatttgtaggatgtgatgcttagattataaagcagattaatgtttatatctgtgaaataaagaatacttttgtgtatgacaaatattaattgcctgaaccagaaaaaaatagtagataagtggaaaataatagccttcaaatgaatctttccacagagacatgaacggtcaaatagaaataatgatggggtgagctattctttcaaggaatgagaatttagaaaacttcagttattatcctaactgttaattaataatttacactattatgaagctaatggataaacttcagaattattctcacttctataattgtcctgtcaccaggtgatattttgtctttttgtcttgtgttaaaaatgtctacactttaataaaaaagggtgagtgggataccagggaacggaactgtttgtttctagcattttccccatttgccacatattactcaagatccctaaaacagatgtcatttccttcttttctgtttttaaattgtatgttatttttggtttatgaactataattatgacttacattattttaaagggtctctagtttttctgaatgaacttaaaagtgtctggaaagtttcgtaggtgattctggtcaatccctggttagttatcttctataaggtagagaatctattgtacatcatagagttaaattagttatttcaattcagatactgctaccttttaaaatcaagttcttatttccagttttcattggtatatacatctgaaatattaatattttcccttgcatgttataattatgggtgtcctttaattcattagaggtgacttttaatctatacatacacttactctatttattttattttttattgttttgaaatgcagtcgccctctgtcaggctggagtgcagtggcacaatctcagctgactgcaacctctgcctcctgggtttaagcaattatcctccctcagcctcccgagtagctgggattacaggcacctgccaccacacctggctaattttttttttttttttttttttttgtatttttagtagagaagggttttcgccatgtaggccaggctggtcttgaactcctgacctcaagtgatctgcctgcctcggcctcccaaaatgctgggattataggtgtgagccaccatacccagccaacatacatttattttattgaaacagattagggcttaggctgcacgtggaaactataaaagttgcatgaagtgttttcagttaaagatacactatacaatatctaccttgtggaatttttatttaacatgttgggtgattttccctctagtgttcaagtatatatatagtaggagagtttatattttacattctcctaattgaaatgtgttatttgaatgtaggcttgtatctaaattcctgggcctgccctttttctctctctaggaatattaagaaatttaaaatccattaatttaagtttttgaggatggaaataggtaagcaatgtgtggattgtggttaggaatgtctgtgcctttgttcagatgtcggctgtgtgtgtgacgaaaaccacagctgccaagtccccaacatgcacctgttgaagtcatcaggtgaaaatgtttaagactttgaaagtgctcataaaggaagaaggggaaatgttatcaaggctttaaagagagggtaagtgccttgaagaagaatgcagtaaactgggcatatttgtggcacagcaaaatcaccctgatcgctggagtgctggctgagttaacatagacttcagcttaaggaatcctacagcagacaagaatttatctcagagtacttactatgacattaccctaggcaactggtaacatttagtataatttagttaataaaatattaagttgtgcctggaaaaaatagcatttggtccttcatagcaggcaaagcaattcacagcattgggaaaaaaaaatacatacatacatatacatgtatgtatacccatatatatgtatatacatgcatgtatacccatatatatgtatatacttacatgtatatacatatatatgtatgtacgtacatatatacccatatctatgtatgtacgtacatatatacccgtatatatgtacgtacatatatacacatatatgtatgcacgtacatatatacacatatatgtatgtacgtacatatatacacattatgtacatacatatatacgtatatatgtacatgcatgtatgtatgtatatacgtacgcatacacacatatatttatatacgtacgcatacacacatatatgtatatacgtacgcatacacacatatatgtatatacgtacgcatacacacatatatgtatatacgtacgcatacacacatatatgtatatacgtacgtatatacacacatatatgtatatacgtacgtatatatgtatttttatgttttatgtatatgtattttatatgtatatatatctgcacatccttcactattttcatgaggaaattggagctcagggatcttagttaccttgccaaaatcatgtgactgaatagtaacaaaagtttgggcttaaaataaggaagactgataataagtgttaagcttatattcctgtctaacaatgacccctggcaaagacatctgatatataagccacgtctgatatataagacgtgatatataagccagaggcactgaatgaacattggcgaaatggacaagaagggtgggacacttatgtccagggactaggtgaaagtcctggagcttttggctttccagccaccttcccagcataaagaaattgtagctaaagttaagggaatgaatagaagtattggccaaaagagaaattattttgttgtttaagagatctggccgggcgcgatggctcacgcctgaaatcccagcactttgggaggccgaggcaggcagattacgaggtcaggagatccagaccatcctggctaatgcggtgaaaccccgtctctagtaaaaatacaaaaaaaatagccaggcatcgtggcgggcgcctgtagtcccagctactcaggaggcttaggcaggagaatggcgtcaacctgggaggcggagcttgcagtgagccgacatagcgccactgcactccagcctgggcaacagagcaagactccgtctcaaaaaaaaaaaaaaaaaaaaaaagagagatccagaggtaactttacagttacattttcatcactgcttctgtaaatttactttagtaaaagctgtctattctcactttattttccaaaatctcttaaaaaataatagtgattatgcttcaaggtttctgaaaatgcttccacttgtgggaaattttgttgcaaaatggttttctttctaaacttacgctagttagttaaatgcaaattaaagttagtcgtcttaggagttcatcatagcgtgagtaatggtttgattaatgacattttggtagaggtcctattttttttcataaaagtgctcaatttgagatgacttgttgcaagtatactcatttacaggtaagagtcagctccctatattctctcagagtcattgttatggttattattgtaagtattttacattaatttaacagaaattttttcttccctaacttataactcaactttatgtaaatacagtgatcatcttataaaaatcaaattacagaatgtcttaaaatctgtaaatttgactttgttttaatgttgaaactacaaattcacagaggcataaatctaacatcttaattaaaatgtcaaccatatgcaagaagaaagatagaagttatttagaaagtttaatttgaaaacagaataatgaagcattttaattgatataggatttgttagtatggcttaaaatcagtggactagaagtagctgtgtaggtggtggttggcattatagttgcatttatatatgttcttattaatttcagtttcaaaattgtaagaagcatatgcatatttttaaggtgacattgaaaagtactataaagattctaaatatgttgtttttacaaaacaaaatgtaaataaattattgatttaaaatct

SEQ ID NO: 144640 - DNA, 4771 bp, Homo sapiens
  Payload ID: 8576
  Gene Symbol: ICMT
  Gene Name: isoprenylcysteine carboxyl methyltransferase
  Uniprot ID: O60725
  ENST ID: ENST00000343813
  CDS Start-End: 30-884
cgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgggtggatcatgaggtcaggcgttcgagaccagcctggccaacatgataaaaccccgtctctactaaaaatacaaaaaaatagctgggcgtgctggcgggtgcctgtaatcccagctactcaggaggctgagacaggagaatcctttgaacccaggaggcggaggttgcagtgagttgagatcgggcctttgcacttcagtctgggcaacagggcgagactccatctcaaaaaacaacaacaacaacaaaaaaaaccggacggacttgcccatcggccctcacgacacgcgtgcagtgggactctagccaaggcggtggccgagccatcattacaatttttctggagtaaaggatccacggtgggacatcaactggcacttactctgtttaggaacttgagttgaatcatttctaaacttgtcctttagaccacgcctagggcagcaaattccacttcctagaactgcaaaccgggagaggatgtagttagattctggcatcctgccccggctctttgagggaaaagttctttcccctgctctaagtagggcgggcccagcctccattcccattgggagccatgaagttgtcttgttgataggtctagggcagctgttggcagctgctggccttgtggatggtaagctgactgtgttggcatttaatgccatcctccatctgccagaggcccaggaagcccaccttcacaccaggcccaccagctggaaggagcccaggaggcaggtcttagggtttcatggtgaaatgctgtctgacaccagggaaaacttgacgtactctgctttggagaggaattccaggggtagggatggtgggagaacattcccaccctgtttataatcccagagcagaagtcagcaattacttagggataaaagatgaactccattttttttattttcttaagacagtcttgctctgtggcccaggctggaggctggagtgcagtggcaccatttcggctcaccgcaacctctgcctcccgggttcaagcgattctcctgcctcagcctcctgagtagctgggattacaggcttgggccaccatgcccagctaatttttttgtatttttagtagagacggggtttcaccatgatggccaggctggtctcgaactcctgacctcaagtgatccacgcgcctcggcctcccaaagtgctgggattacaggcgtgagccaccacgcccagccaagatgaactccttaaggacaggatttggtaagtgattgacttctttttagttccatgatcttgagattatttttagctttataaatttagcagtggcagggcccgtggagaatcaggttaatgaggtaaaggctttctgggtatttgctgccaaggccacatcaccaattttctcgatttaaaaaactgtcaagagatttatttttccattgcaggttttaaagtggagattctgaagtggaaaataggtactgtcagaacaaagctacctggaaacagcatagagtgaagcctttcgtgagggcttgcaggccgctgctgagtggcagtttacagaagaggtcgcggggtgagcctcttagcaggacagaaaacaaggcagcagcgcacctgccaccccttcacgagctgctccttgagcctaaaaagtaggctttattcatcccttctgttcatttaccaacctgggggattgatacgaccggggaaaatgttcctaaaccaggaagctgcgttagccgatcaggctttgtaagatctcgccaacagctagctgcttaggagtacccccacgatacgcacagcacaccactgtcccttcactgcactttcttcctgccttaggtagttgggcttgcccaccctagtttgcttttgtagtggtttggcaaggttagaaggcctcggcctctctgtcatgctgggaagtgcctactctctgggccactgctgcagaggccgtggcacttgtcatgggtttggaagacccagccatctgcagcagaggcagcctatcccattgcaaggagaggaactgaacggagtaattattctactcttctttttacataaatgtttatttaaatattctaaattggattttctttcacagatactgattattctttccagttcttaaataaaactgcacttgatttcactcaa

SEQ ID NO: 144641 - DNA, 2612 bp, Homo sapiens
  Payload ID: 8576
  Gene Symbol: ICMT
  Gene Name: isoprenylcysteine carboxyl methyltransferase
  ENST ID: ENST00000489498
  CDS Start-End: 62-412
gccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctggtcacatctagtgcatccccacagccactgtaggatttttccctacactatgatttcagtcccttgagccttctagtctgacctggatatgaaccagtggcttcaaggtacatgtgctccctgtcattgttccactattctgaatacttggtgacagcagtcaataatcccaaaagtctgtccttggattcctttctcctgaatcacagcctggagtatacagtagctgctctttcttcttggttagagttcacacttgaaaatatcttttggccagaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttatttctgtcccccactgcatgaacatctatacaattttaaaaatacttcctcataggatgctttggcccttcatctatttaatcatagctacatacctattttttataagtagcagtacacattcaaaggggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctaga

SEQ ID NO: 144642 - DNA, 1227 bp, Homo sapiens
  Payload ID: 8576
  Gene Symbol: ICMT
  Gene Name: isoprenylcysteine carboxyl methyltransferase
  ENST ID: ENST00000474756
  CDS Start-End: 62-346
gccggcgcgtttctccgggctacagccggcgccgccgcccgctagtccgccgcccggcgccatggcgggctgcgcggcgcgggctccgccgggctctgaggcgcgtctcagcctcgccaccttcctgctgggcgcctcggtgctcgcgctgccgctgctcacgcgcgccggcctgcagggccgcaccgggctggcgctctacgtggccgggctcaacgcgctgctgctgctgctctatcggccgcctcgctaccagatagccatccgagcttgtttcctggggtttgtgttcggctgcggcacgctgctaagttttagccagtcttcttggagtcactttggctgaactgaagcagattacctggctcagtgtcacagggctgctgatggtggtcttcggagaatgtctgaggaaggcggccatgtttacagctggctccaatttcaaccacgtggtacagaatgaaaaatcagatacacatactctggtgaccagtggagtgtacgcttggtttcggcatccttcttacgtcgggtggttttactggagtattggaactcaggtgatgctgtgtaaccccatctgcggcgtcagctatgccctgacagtgtggcgattcttccgcgatcgaacagaagaagaagaaatctcactaattcacttttttggagaggagtacctggagtataagaagagggtgcccacgggcctgcctttcataaagggggtcaaggtggacctgtgacgggcagtggccccggtgaccttggggcctccgaccctgtgcagcctgggacaaaactgtttccggttggccgctgccacatggattttcttaatcgttttatgtcattagtcactcttctggaatgtcactcaagaccaagcggtcagaaggcctgaggacccaaggccccactggagcagtctgtccttatgccgaatcaaggcggaacatgggtgaaagacgagtaaggggcaaatcacagcaatattccacagcgccctccagagttacctggggaggaccgaggccacacgccactgcccccgaggccagagtgtaagtaaaggataaccaggactcgctgggagagatggactctgtcctcagcaacactccacagcagaaaggggtagcaggtaccccttcttatcagcggtaaaaatgcatttacaacctttcatttaaccgaaaaacacagaccgctttaacctctttattt

SEQ ID NO: 144643 - DNA, 920 bp, Homo sapiens
  Payload ID: 8577
  Gene Symbol: IVD
  Gene Name: isovaleryl-CoA dehydrogenase
  ENST ID: ENST00000473112
  CDS Start-End: 1-920
ggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagcctgggtccatggatcttggagtgtgttcagtaaacatctgctcctggggcaataatgaagggcagaccttttccgcccaacacccacctgggagggagggcgagacccgaggtcagacgtccctggagcaggtgagcactgcgagggaactgagatgcaagatcctcctgcctgaactcacaccccgcgtgctgctcccc

SEQ ID NO: 144644 - DNA, 4251 bp, Homo sapiens
  Payload ID: 8577
  Gene Symbol: IVD
  Gene Name: isovaleryl-CoA dehydrogenase
  Uniprot ID: P26440
  ENST ID: ENST00000479013
  CDS Start-End: 25-1215
agtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcaggaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaacacttgtggttccaagcattttggataaggcaaattcaactttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggtggtggtgcacgtctgtaatcccagctactcaggaggctgaggcaggagaatcacttgaacccgggaggtggaggttgcaatgagccaatatgacaccgctgcagtccagcctgggccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccgggaggcagagtttgcagtgagccaagatcacaccactgcactccagcttggacgacagagcgagactctgtctcaaaaaataataggccaggcatggtggctcaacgtctgtaatcccagcactttgggaggccgaggcgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcaaaaaataataataaaataaatgaacacacatgctgctgagtccgcagggggggcagagcagaggacagcgtgcttttgtgtactgttggaagactggctcctcctgtacagcacctctgagcccttgtgcaccgccctgccacgggcaccatccagtcctggccgtgtgaccacccacagctgactgggcagcaggcacaggccctacccgagcaggccggagttggctcgcatgactccagctgaggctgcctgtgtacatttctccagataccctatggctaattttgttataactgcacagtggctgctgccattttgtattaaatatattgtgaaacaaacctatctggggagaagcaatctacttgccgctgcttcctgtctggatccagcttgtgtccttggagagtggctggcccaggtcctattcctgtcctccagcccgttctttcatgagggacaggaaggtaaaatcagcccttaggagagaggtctcagcctccctttcccagatctcccagtgagttttaaaggaagcagggagcccagagtgctaagttcttacagccagaaggaagcttatagatttctgaaaaccgcccctttgtttttaaaaagatcaacacaatttgactttctcaaggtcaaaacgaactagaatccagatctgctcatggcaaaaatgggggtgttctgagaattccagctttgggccgcactgtacagcagtctggatagagtgtgatctgagaagggaatgggtctgggttgttccaccccttccgagttccaaaaagagggaactggttttcttggttctcagcccagcagcacctatcctggctcttggtcctggcctgcagccaagtgctgttcctagcctgaggcttgagacaggtggggttggctcctcaccaaccccagttccgtcccatcctgagggcaagatcctgggctcataggcagtccctttcacttccttgtcttgctccctgctatgttggagatgaatgtgactaaaagggccatcttgctggcttaatgtgtggctggagagaccagcctggagacaatgtggcaaaatggggcgcttcatccagtctgtctaagccctgtcgacttggggaggtgatttctttcctggttctatatgtgaagcaaaataaatgttttaaaattaaaagcaaaaaaaa

SEQ ID NO: 144645 - DNA, 1809 bp, Homo sapiens
  Payload ID: 8577
  Gene Symbol: IVD
  Gene Name: isovaleryl-CoA dehydrogenase
  ENST ID: ENST00000487418
  CDS Start-End: 25-1305
agtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggttaagtatccctaatcctgaaatctgaaa

SEQ ID NO: 144646 - DNA, 999 bp, Homo sapiens
  Payload ID: 8577
  Gene Symbol: IVD
  Gene Name: isovaleryl-CoA dehydrogenase
  ENST ID: ENST00000481262
  CDS Start-End: 1-437
tctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttgggcagaccttttccgcccaacacccacctgggagggagggcgagacccgaggtcagacgtccctggagcaggtgagcactgcgagggaactgagatgcaagatcctcctgcctgaactcacaccccgcgtgctgctcccccaactcgcctcttggatctcagaccagaagcttcctttcctcaaaatccttctatgttctccaacgtctttgggacagagctccttggcagggtttacaaagcttaggtggccctacccacttctccagcctcatctgctgcctcacccctataccacagctctgcacctttgctgaaactggtactcggcgcttggggtgtcctcatc

SEQ ID NO: 144647 - DNA, 1148 bp, Homo sapiens
  Payload ID: 8577
  Gene Symbol: IVD
  Gene Name: isovaleryl-CoA dehydrogenase
  ENST ID: ENST00000491554
  CDS Start-End: 1-732
gctgacgtcctgattgtctatgccaagacagatctggctgctgtgccagcttctcggggcatcacagccttcattgtggagaagggtatgcctggctttagcacctctaagaagctggacaagctggggatgaggggctctaacacctgtgagctaatctttgaagactgcaagattcctgctgccaacatcctgggccatgagaataagggtgtctacgtgctgatgagtgggctggacctggagcggctggtgctggccggggggcctcttgggctcatgcaagcggtcctggaccacaccattccctacctgcacgtgagggaagcctttggccagaagatcggccacttccagttgatgcaggggaagatggctgacatgtacacccgcctcatggcgtgtcggcagtatgtctacaatgtcgccaaggcctgcgatgagggccattgcactgctaaggactgtgcaggtgtgattctttactcagctgagtgtgccacacaggtagccctggacggcattcagtgttttggccatgcccctcaacccttcctctacactgaaccagtgaactatcaagctccccgcaaattcttcagtggctcccagcacctggcagaccttttccgcccaacacccacctgggagggagggcgagacccgaggtcagacgtccctggagcaggtgagcactgcgagggaactgagatgcaagatcctcctgcctgaactcacaccccgcgtgctgctcccccaactcgcctcttggatctcagaccagaagcttcctttcctcaaaatccttctatgttctccaacgtctttgggacagagctccttggcagggtttacaaagcttaggtggccctacccacttctccagcctcatctgctgcctcacccctataccacagctctgcacctttgctgaaactggtactcggcgcttggggtgtcctcatctttcccctacctatggcagcctgcccgaagagtgcctgctccttcaggctccgctctcggcttagccccttcttggaacgtccccgcacctcaccccagccccttgccaggggcagaccctggcagccttccctcgtcctcagcagccattacgtgttgctgtcataaagttatcactctgt

SEQ ID NO: 144648 - DNA, 819 bp, Homo sapiens
  Payload ID: 8577
  Gene Symbol: IVD
  Gene Name: isovaleryl-CoA dehydrogenase
  ENST ID: ENST00000558610
  CDS Start-End: 182-819
ttggcttttgcccgtgggccgttgggagcgccagcgcgggggcgggacgcggggcctccgacctcgggtccagtcctctgacctcggcctcacgtctgtggagtgaagatttgagaccgtgggacagtactgctggaagtagagaggaggagtcgaggctgggagagctcctgagagactgatggtgttttggtggaggattggccaggctacctaccgcttgtggcacaagggccctcaatctgtatgtagttcacttacacctgaacaggctgagcttcgtcagaccatggctaagttccttcaggagcacctggcccccaaggcccaggagatcgatcgcagcaatgagttcaagaacctgcgagaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaaaggaaatcactacatcctgaatggcaacaagttctggatcactaatggccctgatgctgacgtcctgattgtctatgccaagacagatctggctgctgtgccagcttctcggggcatcacagccttcattgtggagaa

SEQ ID NO: 144649 - DNA, 295 bp, Homo sapiens
  Payload ID: 8577
  Gene Symbol: IVD
  Gene Name: isovaleryl-CoA dehydrogenase
  ENST ID: ENST00000559575
  CDS Start-End: 1-124
ctgcgatgagggccattgcactgctaaggactgtgcaggtgtgattctttactcagctgagtgtgccacacaggtagccctggacggcattcagtgttttgtttctagaggtatcagctcctagcagcttatgaacacatatgcttgcttggccaggcaaggtggtgtgtgcctgtaatcccagcactttgggaggccaaggcaggtggatcacttgcagtcaggagttcaagaccagcctgtccaacgtggtgaaaccccatctctactaaaaatacaaaaattagccaggggt

SEQ ID NO: 144650 - DNA, 428 bp, Homo sapiens
  Payload ID: 8577
  Gene Symbol: IVD
  Gene Name: isovaleryl-CoA dehydrogenase
  ENST ID: ENST00000466756
  CDS Start-End: 1-175
ccattgcactgctaaggactgtgcaggtgtgattctttactcagctgagtgtgccacacaggtagccctggacggcattcagtgttttggccatgcccctcaacccttcctctacactgaaccagtgaactatcaagctccccgcaaattcttcagtggctcccagcacctgtaagatctaaggcttggcaaggcaaatatgactctgatccccctgggccttccccttctgctgcttccctccttccctgctgaatgttcgtgttcttgttgcaaggagtcctcactgccatgtttctcatccctgtgcctttggtctggggcagctctggaagtccttccagcccttcaaactttctcttgcttcctcatctctaaagcctcaggccagggcctgcctccttcaggaagacctctcttctccaacc

SEQ ID NO: 144651 - DNA, 668 bp, Homo sapiens
  Payload ID: 8577
  Gene Symbol: IVD
  Gene Name: isovaleryl-CoA dehydrogenase
  ENST ID: ENST00000610693
  CDS Start-End: 25-668
agtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcagcttcgtcagaccatggctaagttccttcaggagcacctggcccccaaggcccaggagatcgatcgcagcaatgagttcaagaacctgcgagtgagttgggaggtccgggcagtcgggggcagtcagggagtggggctgagctgcactgctgcctggaagagctcacacagttttctggaattttggaagcagctggggaacctgggcgtattgggcatcacagcccctgttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaagctgatcagtggtgagtacatcggagccctggccatgagtgagcccaatgcaggctctgatgttgtctctatgaagctcaaagcggaaaagaa

SEQ ID NO: 144652 - DNA, 2593 bp, Homo sapiens
  Payload ID: 8578
  Gene Symbol: ISM1
  Gene Name: isthmin 1, angiogenesis inhibitor
  Uniprot ID: B1AKI9
  ENST ID: ENST00000262487
  CDS Start-End: 7-1401
aaaaggatggtgcgcctggcggccgagctgctgctgctgctggggctgctgctgctcacgctgcacatcaccgtgctgcgcggctcgggagccgccgacgggcccgacgcggccgcgggcaacgccagccaagcccagctgcagaataacctcaacgtgggaagtgacaccacatcagaaaccagcttttctctctccaaagaagcaccaagggagcatctggaccaccaggctgcacaccaacccttccccagaccgcgattccgacaagagacggggcacccttcattgcaaagagatttccccagatcctttctccttgatctaccaaactttccagatctttccaaagctgatatcaatgggcagaatccaaatatccaggtcaccatagaggtggtcgacggtcctgactctgaagcagataaagatcagcatccggagaataagcccagctggtcagtcccatcccccgactggcgggcctggtggcagaggtccctgtccttggccagggcaaacagcggggaccaggactacaagtacgacagtacctcagacgacagcaacttcctcaacccccccagggggtgggaccatacagccccaggccaccggacttttgaaaccaaagatcagccagaatatgattccacagatggcgagggtgactggagtctctggtctgtctgcagcgtcacctgcgggaacggcaaccagaaacggacccggtcttgtggctacgcgtgcactgcaacagaatcgaggacctgtgaccgtccaaactgcccaggaattgaagacacttttaggacagctgccaccgaagtgagtctgcttgcgggaagcgaggagtttaatgccaccaaactgtttgaagttgacacagacagctgtgagcgctggatgagctgcaaaagcgagttcttaaagaagtacatgcacaaggtgatgaatgacctgcccagctgcccctgctcctaccccactgaggtggcctacagcacggccgacatcttcgaccgcatcaagcgcaaggacttccgctggaaggacgccagcgggcccaaggagaagctggagatctacaagcccactgcccggtactgcatccgctccatgctgtccctggagagcaccacgctggcggcacagcactgctgctacggcgacaacatgcagctcatcaccaggggcaagggggcgggcacgcccaacctcatcagcaccgagttctccgcggagctccactacaaggtggacgtcctgccctggattatctgcaagggtgactggagcaggtataacgaggcccggcctcccaacaacggacagaagtgcacagagagcccctcggacgaggactacatcaagcagttccaagaggccagggaatattaaagagactgggatgaggtggaggacgctgcctctggttctggagcacacacgtgctgcactgacgtgccgactggcgccgagaccttcatagctgcggtcgtgtatatttgtatataccacatgagtatttctcatacattacgctaggggcgtgtgccacgcccaggggactgccttgtgaagccgccctcgccatctgcagagctccttgaaagtgcccctggggagcgatgtgggcagaaggatggggacaacttggaagccagaagaagaacctggaagccacagtgggtgcgactcaattcacacccggatccagagtttcaaagagaggcaaagggggaaagagactgaggttgtaaacgttataagcagtttttatatataacttatttaatacaaatgtgacttaattaagcgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttagttttttatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaagagagtatataataaaatcataataaaaggtg

SEQ ID NO: 144653 - DNA, 3045 bp, Homo sapiens
  Payload ID: 8579
  Gene Symbol: ISM2
  Gene Name: isthmin 2
  Uniprot ID: Q6H9L7
  ENST ID: ENST00000216481
  CDS Start-End: 24-254
agagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagagccccctttccaggtgcgcgctagctcggagaggagtcccgccggtgcgaggaatctggcgctttgcggagtggcgggccagggccgctgaggttcaaacggtcaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggcccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgcacataagtgttagccagcagctccagaaaaatcccgattcccgggatctgccacgagtcactcctactccaccctgatggccagcagaggaagggccactcttctcatgggcacagccatcctttgccggggggggcatccagcctgggtggccacccctccttatctctgggtggtgcacatgcccttctttccccactccctgccacgagccactgcacaggaggctatctgtagccccaagctgcctttctgttggacaccaactttagtcttgggctgcaagccagcccagctgaggcgaagtggactccaggcagggaatgggttgcccaattctggtccctttcctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcactgaatgcactgaactcagagttgggaagagatgcacataatcgctctcccggcacacctcatgcctcttccctgcctccccattcccctggctgcacttccttgccttctatggggttgaaatattgaagtctcaactgtctctgttcacaagagccaccaaaagttaggggacttcagtcctagcccccagatggccgccctgaagctctctgggctcctcagcaataaagcactttattttcaaa

SEQ ID NO: 144654 - DNA, 2971 bp, Homo sapiens
  Payload ID: 8579
  Gene Symbol: ISM2
  Gene Name: isthmin 2
  Uniprot ID: Q6H9L7
  ENST ID: ENST00000342219
  CDS Start-End: 58-1773
gactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaagggggaggaaaaggaggaagacgaggactatccttcagaggatatcgagggtgaggatcaagaggacaaagaggaagatgaggaagagcaggcgctctggttcaatggaactacagacaactgggaccagggctggctggcccccggggattgggtcttcaaggattctgtcagctacgactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgcacataagtgttagccagcagctccagaaaaatcccgattcccgggatctgccacgagtcactcctactccaccctgatggccagcagaggaagggccactcttctcatgggcacagccatcctttgccggggggggcatccagcctgggtggccacccctccttatctctgggtggtgcacatgcccttctttccccactccctgccacgagccactgcacaggaggctatctgtagccccaagctgcctttctgttggacaccaactttagtcttgggctgcaagccagcccagctgaggcgaagtggactccaggcagggaatgggttgcccaattctggtccctttcctttgctcagccccctctgttctgctgattgtagggatgtgcagggctgggagttggcactccccccgagtggggaggtgacagcttgtcacagtagccaggcttgggtgggttcagcactagctcgggacggtgtgtcacacgtctatagtaaaccagttctctgggaggggaaaaaagccctgatttattgcatttgggcagcttctgtggtgtaaattctcccagcagtgtcccatgtcatgctgccagcatcactgaatgcactgaactcagagttgggaagagatgcacataatcgctctcccggcacacctcatgcctcttccctgcctccccattcccctggctgcacttccttgccttctatggggttgaaatattgaagtctcaactgtctctgttcacaagagccaccaaaagttaggggacttcagtcctagcccccagatggccgccctgaagctctctgggctcctcagcaataaagcactttattttc

SEQ ID NO: 144655 - DNA, 913 bp, Homo sapiens
  Payload ID: 8579
  Gene Symbol: ISM2
  Gene Name: isthmin 2
  ENST ID: ENST00000471734
  CDS Start-End: 1-221
cgaggctcgcagaggtgagtggcggcggcaccgggctgcggagcgcgctgtcggtcccacctccccagcccgccggctccagccgtgcggggagcgggaccgggacacacacaggcagcgaccccccgatggagagaggggccggggccggccggaagctcccggacaccgggcgttgcccaggtgcgccggacttcggggcttccactcctcgcgcgtgaccgcgagccgggctgccgcggaccagccgggtgacaagtttgacttctgtgcggagtgaggtggccgacactccacggtggccgggcttcctcgccctgagcggacctcgcctgcagccccctttccaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccaggtgaccatcaaggtggtggaggacccccaggccgaggtgtcgatagacctgttggctgagcccagcaatcccccgcc

SEQ ID NO: 144656 - DNA, 944 bp, Homo sapiens
  Payload ID: 8579
  Gene Symbol: ISM2
  Gene Name: isthmin 2
  ENST ID: ENST00000480979
  CDS Start-End: 1-313
ctgcgtgctgctgctggcggcgctgctggaggcggcgctagggctccccgtgaagaagccgcggctccgcggaccacggcctgggagcctcacgaggctcgcagaggtgagtggcggcggcaccgggctgcggagcgcgctgtcggtcccacctccccagcccgccggctccagccgtgcggggagcgggaccgggacacacacaggcagcgaccccccgatggagagaggggccggggccggccggaagctcccggacaccgggcgttgcccaggtgcgccggacttcggggcttccactcctcgcgcgtgaccgcgagccgggctgccgcggaccagccgggtgacaagtttgacttctgtgcggagtgaggtggccgacactccacggtggccgggcttcctcgccctgagcggacctcgcctgcagccccctttccaggtgcgcgctagctcggagaggagtcccgccggtgcgaggaatctggcgctttgcggagtggcgggccagggccgctgaggttcaaacggtcaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggtta

SEQ ID NO: 144657 - DNA, 1739 bp, Homo sapiens
  Payload ID: 8579
  Gene Symbol: ISM2
  Gene Name: isthmin 2
  Uniprot ID: Q6H9L7
  ENST ID: ENST00000493585
  CDS Start-End: 24-902
agagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggcttcagcctccccagatcctaggcctctgagggaagaggaggaggcacgactgctccccagaacccacctgcaggcagagctacaccaacatggatgttggactgtcactgagccagcagccctgaccccagggaatgccacgcctcccaggacccaggaggttactcccttgctgctggagctgcagaagctgccagaattggtccacgcaaccttgagtacccctaaccctgataaccagactatgagcctcagaaggagtggagtccctggtctccctgcagtgggaactgcagcactggcaagcagcagaggactcggccctgtggctatggctgcactgccaccgagacccgtacctgtgacctgccctcctgtcctggcactgaggacaaggacaccttgggcctccccagtgaggagtggaagctcctggcccgcaatgctacggacatgcatgatcaagatgtggacagctgtgagaagtggctgaactgcaagagcgacttcctaatcaagtatctgagccagatgctgcgggacctgcccagctgcccgtgtgcctacccactggaggccatggacagccctgtgagcctacaggacgagcaccagggccgcagcttccggtggagggatgccagtggccctcgcgagcgcctggacatctaccagcccacggcgcgcttctgcctgcgttccatgctgtctggggagagcagcacactggccgcccagcactgctgctatgacgaggacagccggctgctgacccgtggcaagggcgccggcatgcccaacctcatcagcaccgacttctcacctaagctgcacttcaagttcgacacgacgccctggatcctgtgcaagggggactggagccgcctccacgctgtgctccctcccaacaacggccgagcctgcaccgacaaccccctggaggaggagtacctagcacagttgcaggaggccaaggagtactagtgacggggttgctgaacagacactgcagggagagggcaggcggctgctgctgttgcacgggagaactttcctcacccgcccctgcccagacagggtgaggaaagggctcccccagtgaggttggtccgaggctgtgtgccctctgccagcgaccccgaagcagatatctcagtggggttagtgagaaggttgaagggtatgtagggcccagggtgggtgtccctgggagccctggaaatgtgcatatgtgcatgtgtctgccggggcctccctctgctgcctgctgggaccctggccactcatttttctcctccttgggagctgggctcttctgccctggctctgc

SEQ ID NO: 144658 - DNA, 579 bp, Homo sapiens
  Payload ID: 8579
  Gene Symbol: ISM2
  Gene Name: isthmin 2
  ENST ID: ENST00000554801
  CDS Start-End: 24-579
agagcagcctcggaaccgagacgatgcgtgcgctccgcgaccgagccgggctcctcctctgcgtgctgctgctggcggcgctgctggaggcggcgctagggctccccgtgaagaagccgcggctccgcggaccacggcctgggagcctcacgaggctcgcagaggtctcagcctccccagatcctaggcctctgaaggaagaggaggaggcaccactgctccccagaacccacctgcaggcagagccacaccaacatggatgctggactgtcactgagccagcagccatgaccccaggcaacgccacccctcccaggaccccagaggttactccgttgcggctggagctgcagaagctgccgggattggccaacacaaccttgagtacccctaaccctgatacccaggtgaccatcaaggtggtggaggacccccaggccgaggtgtcgatagacctgttggctgagcccagcaatcccccgccccaggatacccttagctggctgcccgccctctggtccttcctctggggagactacaaaggagaggaaaaagacagggccccaggggagaaggggg

SEQ ID NO: 144659 - DNA, 1704 bp, Homo sapiens
  Payload ID: 8580
  Gene Symbol: ISY1
  Gene Name: ISY1 splicing factor homolog
  Uniprot ID: Q9ULR0
  ENST ID: ENST00000273541
  CDS Start-End: 74-997
cggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacgccaggtgcggtggctcatgcctgtaatcccagcactttgggaggctgaggcgggcggatcacaagctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccaaaaaaaaaaaaaaaaaaa

SEQ ID NO: 144660 - DNA, 988 bp, Homo sapiens
  Payload ID: 8580
  Gene Symbol: ISY1
  Gene Name: ISY1 splicing factor homolog
  ENST ID: ENST00000393292
  CDS Start-End: 63-821
gggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaacgtagtcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctg

SEQ ID NO: 144661 - DNA, 3842 bp, Homo sapiens
  Payload ID: 8580
  Gene Symbol: ISY1
  Gene Name: ISY1 splicing factor homolog
  Uniprot ID: Q9ULR0
  ENST ID: ENST00000393295
  CDS Start-End: 319-1176
tcctcagttcctgcgagcgtcggcttcgtccgggcacttccagtactctcattcacttcctgtccctttcttttacgtttccgacaaaacagtgtctgtgggcagttagaatcttcagtttctgtgagcgtccgcttcgtctgggcacttccggtactcccattcagttccggtccctgtcttttacgtttccggcaaaacatcagtgtctgtgggtagttggaatcttcagttcctgtgagcgtcggcgtcttctgggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccaaaaaaaaaaaaaaaaaaagatgcacgcaacccacaagtcaatgaccaggtccctctgtgttggttgctgctctgggctctccgttagcccccctccacctgctccactcgctcctgcctgggtggcaggaatttgagtttgctattcctgttttataacctgttctgcagaaacctatttttattaaagatttttataagaaagggaaacctccatgtcttcagcttgttccctgggccaacggctctgaggtgacagtggcattaggatgtgaccagtcactaaggggcactgccttcctgcaggggagtccctgaagccccagccccaagtgtggcaaagacaggaccagatcccaggagtctaggtgggagtgagccgacccaccatggcgtccgtggccacagctgtagacagggctccttgcagtgggctgcaccgtggcctgctgaaagcacacagtggacacgagctgagtccagagcttcctctgaactggggcttagctctccagtggggaaccatggtcagcggctgtagcccctgggcaagatggtgcctggcttcctgccctctgcagggtcatgggagtgtctgggaactcagggtcagggccagatggctgttcctggggcctggggctccagctcaggctgtttgggaataggaggaactcttggcttggagaagcccatcacacagcgggaggcctgggatggttggtctgcggggagcagctcagactgggggtggcagagccgtgtgtggctgtgtgtggccaagtcgggagagtggccagtgctgggccctctctaaggagcccgagggccacaaggactgtggaaaaggtctgagtgagggagtcgggagctagtggctaagggacttgcttgaggacgctccgtgcggccacaaggagaggcccaggcaggaccaggtcaggaggaggctggggcagaggccctggcaggaggtgggtgggcttggtggggatgggagtagccagggtgtaggtgaggatggggaaggggcccccctgcctcctggcttccctgagggctgggctggccaatcccagccctcagtcaagcccggaggcaaatgtgtgcagggaggagaggtgtccaggttgaagctttgggagcccttggaggcagcaaggcagactcgcctctgggacccagcacccagcttgggcctgcaggtggggactcaggagtgaatatcgtgggggctttgagcaagaccctctgggcccagcctcaccttccatactttgaagtcaaggagtggacctgtgctgtctcagtttgctctggggtctgggcagtcctgtggtttgggcagaggcctcagagggccctagggacagactgacccaggtctgagcctcttgggagcgtgcggatggccggcctcagacaggcctggttgtgggtttgtcttccaaggggcacacgcgcactctggtgcttcctggcattcagaagagaatggggaatccagacatcaggccttccttctccctgggaaggatggcaggtgcttggagccaggcctgtcttgagagccagggctctgggtcttcctcctccagtgccctgttccacgccttcagtgcacaaagcactcccctcctgggatctcttcagggatccccgggatgcaaactggccagggattagaattccacatttgagcaaacagactgagagtggagaagcacccagctggacatcctctaggtgttcctggcagaggcccttgctacttgtctgtgcccaaaggccctagagggtcctagatgtgggacaaggtctcagcagggctccagtcccaggcctggaaacagctgggggtgggggaagctggctgggtgggtgtggttatcttttcccagcttgtggctccgaggtgacagaaccaatctcaggaggctttgtttggttaataaaatctactgaatggtttatttta

SEQ ID NO: 144662 - DNA, 837 bp, Homo sapiens
  Payload ID: 8580
  Gene Symbol: ISY1
  Gene Name: ISY1 splicing factor homolog
  ENST ID: ENST00000485703
  CDS Start-End: 54-428
gagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggatatatgtcctgccagagtgagcccttgcctgatctcttcagcagttgtgtggtggagattttatttttcctgtgaggcagcttaaaagcagctcattaatccacctagaaaagtggtctcagaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggagga

SEQ ID NO: 144663 - DNA, 752 bp, Homo sapiens
  Payload ID: 8580
  Gene Symbol: ISY1
  Gene Name: ISY1 splicing factor homolog
  ENST ID: ENST00000496163
  CDS Start-End: 1-447
gctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgt

SEQ ID NO: 144664 - DNA, 4868 bp, Homo sapiens
  Payload ID: 8581
  Gene Symbol: ISY1-RAB43
  Gene Name: ISY1-RAB43 readthrough
  ENST ID: ENST00000418265
  CDS Start-End: 62-1057
ggcctgtggagtttcttggacaggggccgcggggctccaggacggcgcccttagcgacaccatggcccgaaatgcagaaaaggccatgacggccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattaacaagctgctaagggagaaaggacactgggaggtccggataaaggagctgggaggtcctgattatggaaaagttggccctaaaatgctggatcatgaaggaaaagaagtcccaggaaaccgaggttacaagtactttggagcagcaaaagatttgcctggtgttagagagctgtttgaaaaagaacctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctgggctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataac

SEQ ID NO: 144665 - DNA, 3089 bp, Homo sapiens
  Payload ID: 8582
  Gene Symbol: ITCH
  Gene Name: itchy E3 ubiquitin protein ligase
  Uniprot ID: Q96J02
  ENST ID: ENST00000262650
  CDS Start-End: 137-2848
gtctagggactgaggagtcgccgccgccccgagtcccggtaccatgcatttcacggtggccttgtggagacaacgccttaacccaaggaagtgactcaaactgtgagaacttcaggttttccaacctattggtggtatgtctgacagtggatcacaacttggttcaatgggtagcctcaccatgaaatcacagcttcagatcactgtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagttatcgttacccctgtgagtaaattacattttcgtgtgtggagtcaccagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaaatggggtttcgctctgtttgcccaggctggagtgcaatagtgcgatctcggctcactgcaacctctgcctcccgggtttaagtgattctcctatctcagcctcccgagtagctgggtttacaggtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaa
